US007091310B2

(12) United States Patent
Merzouk et al.

(10) Patent No.: US 7,091,310 B2
(45) Date of Patent: Aug. 15, 2006

(54) CHEMOKINE ANALOGS FOR THE TREATMENT OF HUMAN DISEASE

(75) Inventors: Ahmed Merzouk, Richmond (CA); Donald Wong, Vancouver (CA); Hassan Salari, Delta (CA)

(73) Assignee: Chemokine Therapeutics Corporation, Vancouver (CA)

(*) Notice: Subject to any disclaimer, the term of this patent is extended or adjusted under 35 U.S.C. 154(b) by 45 days.

(21) Appl. No.: 10/243,795

(22) Filed: Sep. 13, 2002

(65) Prior Publication Data
US 2004/0197303 A1 Oct. 7, 2004

(51) Int. Cl.
*C07K 14/00* (2006.01)
*A61K 45/00* (2006.01)
*C12Q 1/00* (2006.01)
*G01N 33/53* (2006.01)

(52) U.S. Cl. .................... 530/300; 424/85.1; 435/4; 435/7.93

(58) Field of Classification Search ................ 530/300, 530/351; 424/9.1, 85.1; 435/4, 7.1, 7.93
See application file for complete search history.

(56) References Cited

U.S. PATENT DOCUMENTS

| 5,401,651 | A | 3/1995 | Walz .................. 435/240.2 |
| 5,665,346 | A * | 9/1997 | Clark-Lewis et al. ...... 424/85.2 |
| 6,515,001 | B1 | 2/2003 | Saxena et al. |
| 6,693,134 | B1 | 2/2004 | Saxena et al. |
| 2002/0156034 | A1 | 10/2002 | Tudan et al. ............... 514/44 |
| 2002/0165123 | A1 | 11/2002 | Tudan et al. ............... 514/2 |
| 2003/0004136 | A1 | 1/2003 | Saxena et al. .............. 514/63 |
| 2003/0045550 | A1 | 3/2003 | Saxena et al. ............. 514/312 |
| 2003/0092674 | A1 | 5/2003 | Saxena et al. .............. 514/63 |
| 2003/0125380 | A1 | 7/2003 | Saxena et al. ............. 514/468 |
| 2003/0148940 | A1 | 8/2003 | Tudan et al. ............... 514/12 |

FOREIGN PATENT DOCUMENTS

| WO | WO01/76615 | 10/2001 |
| WO | WO01/85196 | 11/2001 |

OTHER PUBLICATIONS

Dermer, G. Bio/Technology, 12: 320, 1994.*
Jain, R. Cancer and Metastasis Reviews, 9: 253-266, 1990.*
U.S. Appl. No. 10/222,703, filed Aug. 16, 2002, Merzouk et al.
Belperio et al., *CXC Chemokines in Angiogenesis*, Leukoc. Biol., vol. 68, pp. 1-8 (2000).
Buser et al., *Calcium Mobilization*, Methods in Molecular Biology, vol. 138, pp. 143-148 (2000).
Clark-Lewis et al., J. Biol. Chem., vol. 269, pp. 16075-16081 (1994).
Daugherty et al., Methods in Molecular Biology, vol. 138, *Chemokine Protocols*, edited by Proudfoot et al., Human Press, Totowa, NJ, pp. 129-148 (2000).
DeNardo et al., *Choosing An Optimal Radioimmunotherapy Dose For Clinical Response*, Cancer 94 (4 Suppl), pp. 1275-1286 (2002).
Francis et al., International Journal of Hematology, vol. 68, pp. 1-18 (1998).
Gazitt, J. Hematother Stem. Cell. Res., vol. 10, pp. 229-236 (2001).
Glimm et al., *Ex Vivo Treatment of Proliferating Human Cord Blood Stem Cells with Stroma-Derived Factor-1 Enhances Their Ability to Engraft NOD/SCID Mice*, Blood, vol. 99(9), pp. 3454-3457 (2002).
Hattori et al., Blood, vol. 97, pp. 3354-3359 (2001).
Kaltsas et al., *The Value of Radiolabelled MIBG and Octreotide in the Diagnosis and Management of Neuroendocrine Tumours*, Ann. Oncol. 12, Supp. 2, pp. S47-S50 (2001).
Kieseier et al., *Chemokines and chemokine receptors in inflammatory demyelinating neuropathies: a central role for IP-10*, Brain 125, pp. 823-824 (2002).
Lane et al., Blood, vol. 96, pp. 4152-4159 (2000).
Mach et al., Curr. Opin. Immunol., vol. 12, pp. 571-575 (2000).
Miller et al., *A novel polypeptide secreted by activated human T lymphocytes*, J. Immunol., vol. 143(9), pp. 2907-2916 (1989).
Nagasawa, Int. J. Hematol., vol. 72, pp. 408-411 (2000).
Nomura et al., Int. J. Cancer, vol. 91, pp. 597-606 (2001).
Ponath et al., *Transwell Chemotaxis*, Methods in Molecular Biology, vol. 138, pp. 113-120 (2000).
Schwarz et al., Nat. Rev. Drug Discov., vol. 1, pp. 347-358 (2002).
Wang et al., J. Biol. Chem., vol. 275, pp. 22313-22323 (2000).
Jennifer H. Dufour, et al.; "IFN-[gamma]-Inducible Protein 10 (IP-10; CXCL 10)-Deficient Mice Reveal a Role for IP-10 in Effector T Cell Generation and Trafficking"; The Journal of Immunology; 2001; 167:7077-7083; pp. 3195-3204; The American Association of Immunologists.
U.S. Appl. No. 10/932,208, filed Aug. 31, 2004, Merzouk et al.

(Continued)

*Primary Examiner*—Janet L. Andres
*Assistant Examiner*—Gyan Chandra
(74) *Attorney, Agent, or Firm*—Squire, Sanders & Dempsey L.L.P.; Brian S. Boyer

(57) ABSTRACT

The present invention is concerned with chemokine analogs, including IL-8 analogs, IP-10 analogs, MIP-1α analogs, RANTES analogs, I-309 analogs, MCP-1 analogs, and CCL28 analogs, that are useful for the treatment of a variety of diseases and disorders, and as an adjunct to the treatment of a variety of diseases and disorders. A therapeutically effective amount of the chemokine analog may be administered to a patient in need of such treatment.

17 Claims, 2 Drawing Sheets

OTHER PUBLICATIONS

Hébert et al., *Sanning Mutagenesis of Interleukin-8 Identifies a Cluster of Residues Required for Recepthor Binding*, The J. of Bilogical Chemistry, vol. 266, No. 28, Issue of Oct. 5, pp. 18989-18994 (1991).

Lejeune et al., *Interleukin-8 has antitumor effects in the rat which are not associated with polmorphonuclear leukocyte cytotoxicity*, Cancer Immunol Immunother 38, pp. 167-170 (1994).

* cited by examiner

Figure 1. Inhibition of $^{125}$I-IL-8 binding by IL-8 peptide analogs
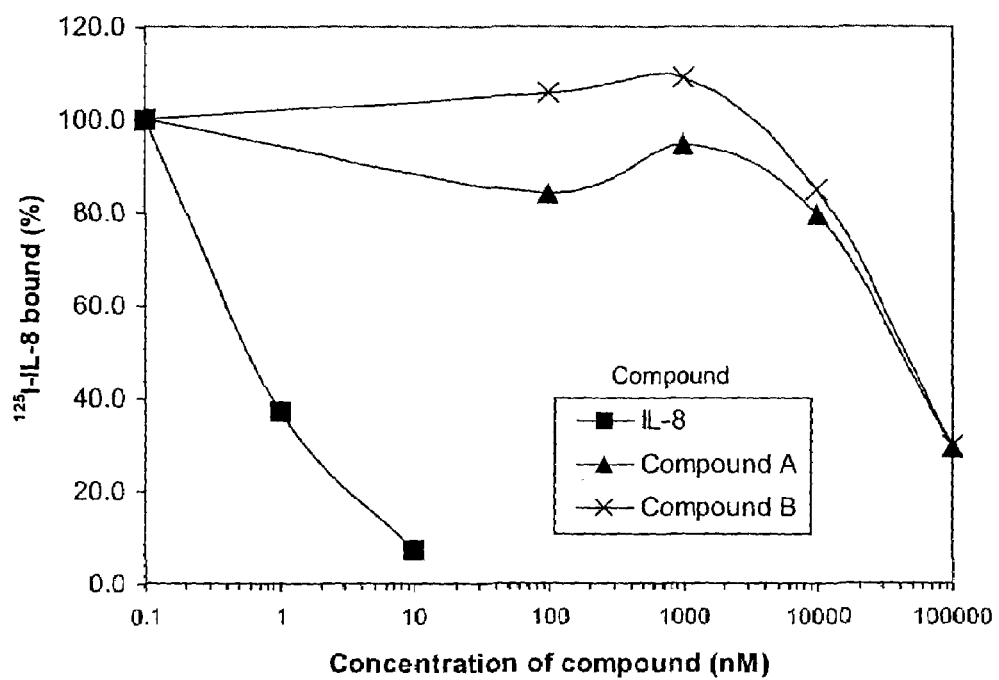

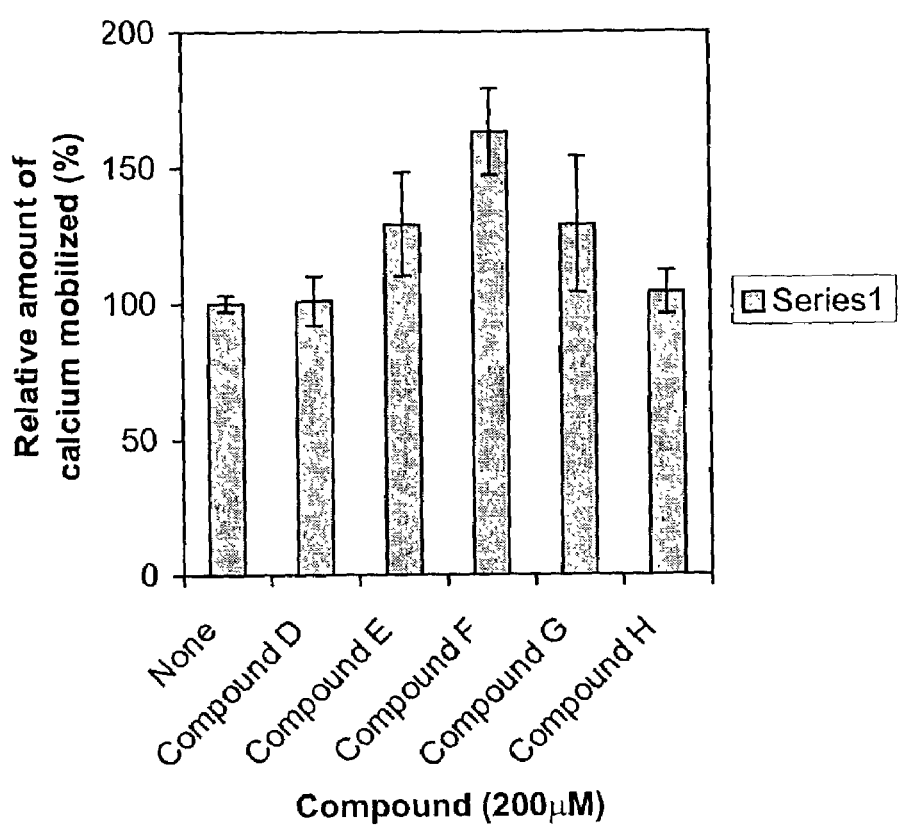
Figure 2. Calcium mobilization by I-309 peptide analogs

CHEMOKINE ANALOGS FOR THE TREATMENT OF HUMAN DISEASE

CROSS-REFERENCE TO RELATED APPLICATIONS

Not applicable.

STATEMENT AS TO RIGHTS TO INVENTIONS MADE UNDER FEDERALLY SPONSORED RESEARCH AND DEVELOPMENT

Not applicable.

FIELD OF THE INVENTION

SEQUENCE LISTING

The instant application contains a Sequence Listing which has been submitted via triplicate CD-R in lieu of a printed paper copy, and is hereby incorporated by reference in its entirety. The CD-R, recorded on Sep. 8, 2003 are labeled "CRF", "Copy 1" and "Copy 2", respectively, and each contains only one identical 1.83 MB file 5929600003.APP.

BACKGROUND OF THE INVENTION

Chemokines (chemoattractant cytokines) are a family of homologous serum proteins of between 7 and 16 kDa, which were originally characterized by their ability to induce migration of leukocytes. Most chemokines have four characteristic cysteines (Cys), and depending on the motif displayed by the first two cysteines, they have been classified into CXC or alpha, CC or beta, C or gamma, and CX3C or delta chemokine classes. Two disulfide bonds are formed between the first and third cysteine and between the second and fourth cysteine. In general, it was thought that the disulfide bridges were required, and Clark-Lewis and co-workers reported that, at least for IL-8, the disulfide bridges are critical for chemokine activity (Clark-Lewis et al., J. Biol. Chem. 269:16075–16081, 1994). The only exception to having four cysteines is lymphotactin, which has only two cysteine residues. Thus, lymphotactin manages to retain a functional structure with only one disulfide bond.

In addition, the CXC, or alpha, subfamily has been divided into two groups depending on the presence of the ELR motif (Glu-Leu-Arg) preceding the first cysteine: the ELR-CXC chemokines and the non-ELR-CXC chemokines (see, e.g., Clark-Lewis, supra, and Belperio et al., "CXC Chemokines in Angiogenesis," J. Leukoc. Biol. 68:1–8, 2000).

ELR-CXC chemokines, such as IL-8, are generally strong neutrophil chemoattractants while non-ELR chemokines, such as IP-10, and SDF-1, predominantly recruit lymphocytes. CC chemokines, such as RANTES, MIP-1-alpha, MCP-1, generally function as chemoattractants for monocytes, basophils, eosinophils, and T-cells but not neutrophils. In general, chemokines are chemotactic agents that recruit leukocytes to the sites of injuries.

Specific Chemokines

IL-8

Interleukin-8 (IL-8 or CXCL8) was first identified in 1987 as a chemokine with the ability to specifically activate neutrophils. Upon exposure to IL-8, neutrophils are activated, and change their shape. Neutrophils are activated by a process that is probably mediated by an increase in intracellular calcium levels. This activation allows neutrophils to migrate across the vascular wall. Secretion of IL-8 can occur from a wide variety of cells, including other leukocytes, fibroblasts, endothelial cells, and epithelial cells in response to ischemia and trauma.

IP-10

Interferon-inducible protein-10 (IP-10 or CXCL10) is induced by interferon-gamma and TNF-alpha, and is produced by keratinocytes, endothelial cells, fibroblasts and monocytes. IP-10 is thought to play a role in recruiting activated T cells to sites of tissue inflammation (Dufour, et al., "IFN-gamma-inducible protein 10 (IP-10; CXCL10)-deficient mice reveal a role for IP-10 in effector T cell generation and trafficking," J Immunol., 168:3195–204, 2002). In addition, IP-10 may play a role in hypersensitivity. It may also play a role in the genesis of inflammatory demyelinating neuropathies (Kieseier, et al., "Chemokines and chemokine receptors in inflammatory demyelinating neuropathies: a central role for IP-10," Brain 125:823–34, 2002).

MIP-1α

Macrophage inflammatory protein-1-alpha (MIP-1α, MIP-1-alpha or CCL3) is a factor produced by macrophages in response to their stimulation by bacterial endotoxins. It activates neutrophils, eosinophils, and basophils and appears to play a role in inflammation. Additionally, it is especially potent as a basophil agonist, and appears to act through a rapid rise in intracellular calcium, and causes the release of histamine, sulfido-leukotrienes, and also plays a role in chemotaxis. MIP-1α may also act to inhibit stem cell proliferation.

RANTES

RANTES (Regulated upon Activation, Normal T-cell Expressed, and presumably Secreted or CCL5) is a chemokine that acts on T-cells, eosinophils and basophils and assists in recruiting leukocytes to inflammatory sites. In particular, it increases the adherence of monocytes to endothelial cells, and selectively supports the migration of certain types of leukocytes. In some cases, RANTES has been shown to activate basophils and causes the release of histamines. It may also be involved in the proliferation and activation of certain types of killer cells.

I-309

I-309 refers to the name of a cDNA clone encoding a chemokine (Miller, et al., "A novel polypeptide secreted by activated human T lymphocytes," J Immunol., 143(9):2907–16, 1989). I-309 is chemotactic for human monocytes, and additionally activates them. However, it appears to have no effect on neutrophils.

MCP-1

Monocyte chemoattractant (or chemotactic) protein-1 (monocyte chemotactic protein-1, MCP-1 or CCL2) is another CCL chemokine. It is expressed by monocytes, endothelial cells, smooth muscle cells, and certain types of epithelial cells in culture. The expression of MCP1 is induced in human peripheral blood mononuclear leukocytes by phytohemagglutinin (PHA), lipopolysaccharide, and IL1. MCP-1 functions as a chemoattractant for monocytes but not neutrophils. There have been reports that two point mutations are sufficient for MCP-1 to become chemotactic for neutrophils. MCP-1 activates monocytes and macrophages in vivo, as well as basophils. Additionally, it can induce the proliferation and activation of certain types of killer cells.

CCL28

CCL28 (hMEC) is a recently described CC chemokine which may play a particularly important role in homeostasis or inflammatory responses in the gastrointestinal system (Wang et al., J. Biol. Chem. 275:22313–23, 2000).

SDF-1

Stromal cell-derived factor-1 (SDF-1 or CXCL12) is a CXC chemokine that demonstrates in vitro activity with respect to lymphocytes and monocytes but not neutrophils. It is a highly potent in vivo chemoattractant for mononuclear cells. SDF-1 has been shown to induce intracellular actin polymerization in lymphocytes, and to induce a transient elevation of cytoplasmic calcium in some cells.

Chemokine Receptors

The receptors for chemokines are G-protein coupled seven-transmembrane receptors. Based on the chemokine class they bind, the receptors have been named CXCR1, CXCR2, CXCR3, CXCR4, and CXCR5 (all of which bind CXC chemokines); CCR1 through CCR9 (all of which bind CC chemokines); XCR1 (which binds the C chemokine, Lptn); and CX3CR1 (which binds the CX3C chemokine, fractalkine or neurotactin (See Table 1)).

The chemokines and their receptors have received increasing attention in the last few years. In addition to their role in HIV pathogenesis, it is now clear that chemokines participate in many pathological conditions such as inflammation and diseases or conditions associated with autoimmune responses. They also play a very important role in normal homeostasis, including lymphoid development and migration, and the growth of bone. As a result of their role in various physiological processes and pathological conditions and diseases, chemokines have important potential therapeutic applications.

TABLE 1

| Chemokine receptors | Human chemokine ligands |
| --- | --- |
| CXCR1 | IL-8, GCP-2 |
| CXCR2 | IL-8, GCP-2, Gro α, Gro β, Gro γ, ENA-78, PBP |
| CXCR3 | MIG, IP-10, I-TAC |
| CXCR4 | SDF-1/PBSF |
| CCR1 | MIP-1 α, MIP-1 β, RANTES, HCC-1, 2, 3, and 4 |
| CCR2 | MCP-1, MCP-2, MCP-3, MCP-4 |
| CCR3 | Eotaxin-1 eotaxin-2, MCP-3 |
| CCR4 | TARC, MDC, MIP-1 α, RANTES |
| CCR5 | MIP-1 α, MIP-1 β, RANTES |
| CCR6 | MIP-3 α/LARC |
| CCR7 | MIP-3 β/ELC, 6Ckine/LC |
| CCR8 | I-309 |
| CCR9 | TECK |
| CCR10 | CCL27, CCL28(hMEC) |

SUMMARY OF THE INVENTION

This invention relates in one aspect to the design, preparation, derivation, and use of peptide agonists and antagonists of chemokines referred to herein as chemokine analogs. In preferred embodiments, this invention relates to the design, preparation, derivation, or use of peptide agonists or antagonists of a chemokine selected from the group consisting of IL-8, IP-10, MIP-1α, MCP-1, RANTES, I-309, and CCL28 (hMEC). In other preferred embodiments, the invention relates to the design, preparation, derivation, or use of chemokine analogs derived from one or more of the seven chemokines: IL-8, IP-10, MIP-1α, MCP-1, RANTES, I-309, and CCL28. Particularly preferred embodiments are set forth infra in the Detailed Description of the Invention, Examples and Claims.

Another aspect of the invention is directed towards a method for treating disease, disorder or abnormal condition comprising administering to a patient in need of such treatment a therapeutically effective amount of a chemokine analog having a structure selected from the group consisting of sequence a1 (SEQ ID NO:9) to sequence a154 (SEQ ID NO:162), inclusive; sequence b1 (SEQ ID NO:163) to sequence b575 (SEQ ID NO:728), inclusive; sequence c1 (SEQ ID NO:729) to sequence c160 (SEQ ID NO:881), inclusive; sequence d1 (SEQ ID NO:882) to sequence d90 (SEQ ID NO:971), inclusive; sequence e1 (SEQ ID NO:972) to sequence e382 (SEQ ID NO:1350), inclusive; sequence g2 (SEQ ID NO:1351) to sequence g97 (SEQ ID NO:1446), inclusive; and sequence h1 (SEQ ID NO:1447) to sequence h184 (SEQ ID NO:1631), inclusive, in a pharmaceutically acceptable carrier.

In preferred embodiments, said disease, disorder or abnormal condition is selected from the group consisting of autoimmune diseases, acute chronic inflammation, cancer, cardiovascular disease, infectious disease, and inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, and organ transplant rejection. In other preferred embodiments, the administration of the compound of the invention serves to increase the hemocrit, assist in mobilizing and recovering stem cells, stimulate the production of blood cells, assist in vaccine production, or assist in gene therapy.

A further aspect of this invention relates to therapeutic uses of chemokine analogs to cure, to manage, or to prevent a disease or disorder selected from the group consisting of autoimmune diseases, acute chronic inflammation, cancer, cardiovascular disease, infectious disease, and inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, and organ transplant rejection. A further aspect of this invention relates to therapeutic uses of chemokine analogs to increase the hemocrit, assist in mobilizing and recovering stem cells, stimulate the production of blood cells, or assist in vaccine production.

Another aspect of the invention is directed towards providing pharmaceutical compositions of chemokine analogs in order to treat a mammal by enhancing or inhibiting the action of a chemokine on its receptor. An additional aspect of the invention relates to the use of pharmaceutical compositions of analogs of human IL-8, IP-10, MIP-1α, MCP-1, RANTES, I-309, or CCL28 to treat a human by enhancing or inhibiting the action of IL-8, IP-10, MIP-1α, MCP-1, RANTES, I-309, or CCL28 on its respective receptor.

A still further aspect of the invention is a method for modulating the activity of a chemokine receptor by contacting this chemokine receptor with a compound comprising a structure selected from the group consisting sequence a1 (SEQ ID NO:9) to sequence a154 (SEQ ID NO:162), inclusive; sequence b1 (SEQ ID NO:163) to sequence b575 (SEQ ID NO:728), inclusive; sequence c1 (SEQ ID NO:729) to sequence c160 (SEQ ID NO:881), inclusive; sequence d1 (SEQ ID NO:882) to sequence d90 (SEQ ID NO:971), inclusive; sequence e1 (SEQ ID NO:972) to sequence e382 (SEQ ID NO:1350), inclusive; sequence g2 (SEQ ID NO:1351) to sequence g97 (SEQ ID NO:1446), inclusive; and sequence h1 (SEQ ID NO:1447) to sequence h184 (SEQ ID NO:1631), inclusive.

Another aspect of the invention consists of using the chemokine analogs of the invention to treat a patient so as to (a) mobilize intracellular calcium in the patient, (b) mobilize leukocytes or more specifically, neutrophils, or (c) decrease the toxic effects of a cytotoxic agent on white blood cells, leukocytes and/or hematopoietic cells.

BRIEF DESCRIPTION OF THE DRAWINGS

FIG. 1 shows a concentration-dependent inhibition of $^{125}$I-IL-8 binding to CXCR1 and CXCR2 by IL-8, indicating the affinity of IL-8 for the CXCR1 and CXCR2 receptors. FIG. 1 also shows the binding of the IL-8 peptide analogs (competing ligands described in Example 1) to CXCR1 and/or CXCR2 receptors on THP-1 cells, a human monocytoid cell line. THP-1 cells were preincubated with IL-8 or IL-8 analog for 30 min, then were assessed for $^{125}$I-IL-8 binding following 2 hr of incubation with $^{125}$I-IL-8. 10 nM of $^{125}$I-IL-8 was added in the presence of IL-8 or the indicated analogs at the concentrations illustrated. The results are expressed as percentages of the maximal specific binding that was determined without competing ligand.

FIG. 2 shows the induction of $[Ca^{2+}]_i$ mobilization by I-309 and I-309 analogs. Fluo-4,AM loaded human peripheral blood mononuclear cells ($5\times10^6$/ml) were stimulated with I-309, Compounds 4, 5, 6, and 7 at the concentrations indicated. The values represent the mean+/−one S.D.

DETAILED DESCRIPTION OF THE INVENTION

The invention relates to the design, preparation, derivation, and use of chemokine analogs. In one aspect, this invention is directed to the synthesis or use of chemokine analogs which bind to receptors for any of seven human chemokines: IL-8, IP-10, MIP-1α, MCP-1, RANTES, I-309, and CCL28 (hMEC). In another aspect, the invention is directed to the synthesis, design, derivation, or use of chemokine analogs or derivatives of one or more of the seven human chemokines: IL-8, IP-10, MIP-1α, MCP-1, RANTES, I-309, and CCL28 (hMEC). In a further aspect, the invention is directed to the synthesis, design, derivation, or use of agonist or antagonist analogs of one or more of the following seven human chemokines: IL-8, IP-10, MIP-1α, MCP-1, RANTES, I-309, and CCL28, and derivatives thereof. The invention is not limited in its application to the details of structures and the arrangements of components set forth in the following description or illustrated in the drawings and the figures. Further, it should be understood that in any claimed list or claimed Markush group, those schooled in the art will recognize that the invention is also thereby described in terms of any individual member or subgroup of members of the list or Markush group. Additionally, any individual member of the claimed list or the claimed Markush group can be removed from the list or Markush group without affecting the patentability of the remaining members.

The sequences of the seven aforementioned human chemokines are shown below. First are two CXC chemokines: IL-8, and IP-10; second are five CC chemokines: MIP-1α, MCP-1, RANTES, I-309, and CCL28.

```
IL-8:    Ala-Val-Ile-Pro-Arg-Ser-Ala-Lys-Glu-Leu-Arg-Cys-    (SEQ ID NO:1)
         Gln-Cys-Ile-Lys-Thr-Tyr-Ser-Lys-Pro-Phe-His-Pro-
         Lys-Phe-Ile-Lys-Glu-Leu-Arg-Val-Ile-Glu-Ser-Gly-
         Pro-His-Cys-Ala-Asn-Thr-Glu-Ile-Ile-Val-Lys-Leu-
         Ser-Asp-Gly-Arg-Glu-Leu-Cys-Leu-Asp-Pro-Lys-Glu-
         Asn-Trp-Val-Gln-Arg-Val-Val-Glu-Lys-Phe-Leu-Lys-
         Arg-Ala-Glu-Asn-Ser

IP-10:   Val-Pro-Leu-Ser-Arg-Thr-Val-Arg-Cys-Thr-Cys-Ile-    (SEQ ID NO:2)
         Ser-Ile-Ser-Asn-Gln-Pro-Val-Asn-Pro-Pro-Arg-Ser-
         Leu-Glu-Lys-Leu-Glu-Ile-Ile-Pro-Ala-Ser-Gln-Phe-
         Cys-Pro-Arg-Val-Glu-Ile-Ile-Ala-Thr-Met-Lys-Lys-
         Lys-Gly-Glu-Lys-Arg-Cys-Leu-Asn-Pro-Glu-Ser-Lys-
         Ala-Ile-Lys-Asn-Leu-Leu-Lys-Ala-Val-Ser-Lys-Glu-
         Met-Ser-Lys-Arg-Ser-Pro

MIP-1α   Ser-Leu-Ala-Ala-Asp-Thr-Pro-Thr-Ala-Cys-Cys-Phe-    (SEQ ID NO:3)
         Ser-Tyr-Thr-Ser-Arg-Gln-Ile-Pro-Gln-Asn-Phe-Ile-
         Ala-Asp-Tyr-Phe-Glu-Thr-Ser-Ser-Gln-Cys-Ser-Lys-
         Pro-Gly-Val-Ile-Phe-Leu-Thr-Lys-Arg-Ser-Arg-Gln-
         Val-Cys-Ala-Asp-Pro-Ser-Glu-Glu-Trp-Val-Gln-Lys-
         Tyr-Val-Ser-Asp-Leu-Glu-Leu-Ser-Ala
```

-continued

```
RANTES:  Ser-Pro-Tyr-Ser-Ser-Asp-Thr-Thr-Pro-Cys-Cys-Phe-   (SEQ ID NO:4)

Ala-Tyr-Ile-Ala-Arg-Pro-Leu-Pro-Arg-Ala-His-Ile-

Lys-Glu-Tyr-Phe-Tyr-Thr-Ser-Gly-Lys-Cys-Ser-Asn-

Pro-Ala-Val-Val-Phe-Val-Thr-Arg-Lys-Asn-Arg-Gln-

Val-Cys-Ala-Asn-Pro-Glu-Lys-Lys-Trp-Val-Arg-Glu-

Tyr-Ile-Asn-Ser-Leu-Glu-Met-Ser

I-309:   Lys-Ser-Met-Gln-Val-Pro-Phe-Ser-Arg-Cys-Cys-Phe-   (SEQ ID NO:5)

Ser-Phe-Ala-Glu-Gln-Glu-Ile-Pro-Leu-Arg-Ala-Ile-

Leu-Cys-Tyr-Arg-Asn-Thr-Ser-Ser-Ile-Cys-Ser-Asn-

Glu-Gly-Leu-Ile-Phe-Lys-Leu-Lys-Arg-Gly-Lys-Glu-

Ala-Cys-Ala-Leu-Asp-Thr-Val-Gly-Trp-Val-Gln-Arg-

His-Arg-Lys-Met-Leu-Arg-His-Cys-Pro-Ser-Lys-Arg-

Lys

MCP-1:   Gln-Pro-Asp-Ala-Ile-Asn-Ala-Pro-Val-Thr-Cys-Cys-   (SEQ ID NO:7)

Tyr-Asn-Phe-Thr-Asn-Arg-Lys-Ile-Ser-Val-Gln-Arg-

Leu-Ala-Ser-Tyr-Arg-Arg-Ile-Thr-Ser-Ser-Lys-Cys-

Pro-Lys-Glu-Ala-Val-Ile-Phe-Lys-Thr-Ile-Val-Ala-

Lys-Glu-Ile-Cys-Ala-Asp-Pro-Lys-Gln-Lys-Trp-Val-

Gln-Asp-Ser-Met-Asp-His-Leu-Asp-Lys-Gln-Thr-Gln-

Thr-Pro-Lys-Thr

CCL28:   Ile-Leu-Pro-Ile-Ala-Ser-Ser-Cys-Cys-Thr-Glu-Val-   (SEQ ID NO:8)

Ser-His-His-Ile-Ser-Arg-Arg-Leu-Leu-Glu-Arg-Val-

Asn-Met-Cys-Arg-Ile-Gln-Arg-Ala-Asp-Gly-Asp-Cys-

Asp-Leu-Ala-Ala-Val-Ile-Leu-His-Val-Lys-Arg-Arg-

Arg-Ile-Cys-Val-Ser-Pro-His-Asn-His-Thr-Val-Lys-

Gln-Trp-Met-Lys-Val-Gln-Ala-Ala-Lys-Lys-Asn-Gly-

Lys-Gly-Asn-Val-Cys-His-Arg-Lys-Lys-His-His-Gly-

Lys-Arg-Asn-Ser-Asn-Arg-Ala-His-Gln-Gly-Lys-His-

Glu-Thr-Tyr-Gly-His-Lys-Thr-Pro-Tyr
```

The N-terminal region of chemokines is involved in the binding and activating site of its receptor, as well as is the carboxy terminal region. The beta sheet structure that connects the two termini appears to play a role in the stabilization of the CXCR and assuring that the termini are in the proper conformation.

Examples of these analogs are compounds containing structures corresponding to various regions or portions of the chemokines. In preferred embodiments, the chemokine analog comprises an N-terminal region and a C-terminal region joined together by means of a linker. In other preferred embodiments, the amino acid residues of the chemokine or chemokine analog are cyclized, e.g., by etherification of lysine and serine residues or by other means described infra or known in the art. In still other preferred embodiments, the chemokine analog comprises a sequence derived from the wild-type chemokine sequence but with one or more of the cysteines replaced with another amino acid including natural and non-natural amino acids). Other preferred embodiments include chemokine analogs comprising an N-terminal region, an internal region containing up to three anti-parallel β-sheets, a C-terminal region containing an α-helical structure, a combination of the N- and C-terminal regions linked together directly, a combination of a N-terminal and internal region, or a combination of an internal and C-terminal region, or finally a combination of N-terminal, internal and C-terminal regions. The regions selected from the N-terminal, internal and C-terminal regions may be 5, 6, 7, 8, 9, 10, 11, 12, 13, 14, 15, 16, 17, 20, 25, 30, 35, 40, 41, or 45 amino acids in length.

Examples of such analogs also include a cross combination of one chemokine region to a different region from a different chemokine in the same or different family. These examples include, but are not limited to, regions of two CXC chemokines: IL-8, IP-10, and five CC chemokines: MIP-1α, MCP-1, RANTES, I-309, and CCL28.

Chemokine analogs of the invention are useful for treating or preventing inflammatory conditions, autoimmune disorders, cancer, graft rejection, bacterial infection, viral infection, vascular conditions (for example, atherosclerosis, restenosis, systemic lupus erythematosis, and ischemia-reperfusion), sepsis, tumorigenesis, and angiogenesis; stem cell mobilization as well as vaccine production and blood cell recovery following chemotherapy. Inflammatory conditions contemplated by the present invention include both acute and chronic inflammatory diseases. Chemokine analogs of the inventions may also prove useful in conducting gene therapy; one manner they may assist in the methods of gene therapy is through an arrest of the cell cycle.

Examples of uses of the chemokine analogs in some aspects of the invention include, but are not limited to, treatment or management of arthritis, asthma, colitis/illeitis, psoriasis, atherosclerosis and the like. Examples of uses of the chemokine analogs in some aspects of the invention to treat or manage autoimmune conditions include, but are not limited to, rheumatoid arthritis, multiple sclerosis and other autoimmunological diseases. Examples of uses of the chemokine analogs in some aspects of the invention to treat or manage cancer include, but are not limited to, treatment or management of human malignancy/cancer cell metastasis and relapses. Examples of uses of the chemokine analogs in some aspects of the invention to assist in blood cell recovery include, but are not limited to, blood cell elevation after chemotherapy/radiotherapy and stem cell mobilization for transplantations. Examples of uses of the chemokine analogs in some aspects of the invention for vaccine production include, but are not limited to, enhancement in humoral antibody production, increases in antigen presenting T-cells, increases in dendritic cells and immunological features known as vaccine induction. Chemokines may also play a role in osteoporosis and thus osteoporosis may be treated by chemokine analogs of the invention. Chemokine analogs of the invention may also prove useful in treating genetic disease through gene therapy.

As defined by the present invention a chemokine analog acts as an agonist or an antagonist to a native chemokine. The agonistic activity of the chemokine analogs of the present invention includes mimicking of biological activity induced by corresponding native chemokines. The antagonistic activity of the chemokine analogs of the present invention includes inhibition of biological activity induced by native chemokines. The instant invention also encompasses a chemokine analog that acts as an agonist or an antagonist to a different native chemokine.

Peptides

In this application, the products of the present invention are referred to by various terms, including "analogs" of the present invention, "chemokine mimetics," "chemokine analogs," and "chemokine derivatives." These terms are used interchangeably and denote equivalent compounds. The term "polypeptides of the present invention," may also be used herein to refer to chemokine analogs. Chemokine analogs of the present invention comprise a structure which comprises a sequence selected from the group set forth as SEQ ID NO:9 through SEQ ID NO:1631, and thus may comprise additional elements such as R-group substituents and a linker selected from the possibilities set forth in the instant invention.

As defined by the present invention, biological activity refers to the biological activity of the native chemokines, as defined and measured by the scientific reports known to those of skill in the art, and exemplified in the following review articles (Daugherty, B. L. et al., "Radiolabeled Chemokine binding assays," Methods in Molecular Biology (2000) vol. 138, pp129–134, Buser, R. et al. "Calcium Mobilization," Methods in Molecular Biology (2000) vol. 138, pp143–148, Ponath, P. D. et al., "Transwell Chemotaxis," Methods in Molecular Biology (2000) vol. 138, pp113–120 Humana Press. Totowa, N.J.). Aspects of biological activity include, but are not limited to, receptor binding, chemotaxis, calcium mobilization, along with other activities recognized by those of skill in the art.

The amino acids are identified in the present application by the conventional one-letter and three-letter abbreviations as indicated below, and are preceded by "L-" to indicate their L-form and by "D-" to refer to their D form. These abbreviations are generally accepted in the peptide art as recommended by the IUPAC-IUB commission in biochemical nomenclature:

| Alanine | A | Ala | Leucine | L | Leu |
|---------|---|-----|---------|---|-----|
| Arginine | R | Arg | Lysine | K | Lys |
| Asparagine | N | Asn | Methionine | M | Met |
| Aspartic acid | D | Asp | Phenylalanine | F | Phe |
| Cysteine | C | Cys | Proline | P | Pro |
| Glutamic acid | E | Glu | Serine | S | Ser |
| Glutamine | Q | Gln | Threonine | T | Thr |
| Glycine | G | Gly | Tryptophan | W | Trp |
| Histidine | H | His | Tyrosine | Y | Tyr |
| Isoleucine | I | Ile | Valine | V | Val |
| Ornithine | O | Orn | | | |

All of the peptide sequences set out herein are written according to the generally accepted convention whereby the N-terminal amino acid is on the left and the C-terminal amino acid is on the right.

Chemokine mimetics of the invention may include chemokine derivatives or chemokine analogs and their derivatives, such as C-terminal hydroxymethyl derivatives, O-modified derivatives (e.g., C-terminal hydroxymethyl benzyl ether), N-terminally modified derivatives including substituted amides such as alkylamides and hydrazides and compounds in which a C-terminal phenylalanine residue is replaced with a phenethylamide analogue (e.g., Ser-Ile-phenethylamide as an analog of the tripeptide Ser-Ile-Phe), glycosylated chemokine derivatives, polyethylene glycol modified derivatives, or biotinylated derivatives. Chemokine analogs of the invention include pharmaceutically acceptable salts of the chemokine analogs.

Modifying Groups

In one aspect of the invention, the chemokine analogs of the invention, (such as peptides derived from IL-8, IP-10, MIP-1α, MCP-1, RANTES, I-309, or CCL28) may be coupled directly or indirectly to at least one modifying group. In some aspects of the invention, the term "modifying group" is intended to include structures that are directly attached to the peptidic structure (e.g., by covalent bonding or covalent coupling), as well as those that are indirectly attached to the peptidic structure (e.g., by a stable non-covalent bond association or by covalent coupling through a linker to additional amino acid residues). In other aspects of the invention the term "modifying group" may also refer to mimetics, analogues or derivatives thereof, which may flank the IL-8, IP-10, MIP-1α, MCP-1, RANTES, I-309, or CCL28 core peptidic structure. For example, the modifying group can be coupled to the amino-terminus or carboxy-terminus of an IL-8, IP-10, MIP-1α, MCP-1, RANTES, I-309, or CCL28 peptidic structure, or to a peptidic or peptidomimetic region flanking the core structure. Alternatively, the modifying group can be coupled to a side chain of at least one amino acid residue of an IL-8, IP-10, MIP-1α, MCP-1, RANTES, I-309, or CCL28 peptidic structure, or to a peptidic or peptido-mimetic region flanking the core domain (e.g., through the epsilon amino group of a lysyl residue(s); through the carboxyl group of an aspartic acid residue(s) or a glutamic acid residue(s); through a hydroxy group of a tyrosyl residue(s), a serine residue(s) or a threonine residue(s); or any other suitable reactive group on an amino acid side chain). In other aspects, modifying groups covalently coupled to the peptidic structure can be attached by means and using methods well known in the art for linking chemical structures, including, for example, amide, alkylamino, sulfide, carbamate or urea bonds.

In some embodiments, the modifying group may comprise a cyclic, heterocyclic or polycyclic group. The term "cyclic group," as used herein, includes cyclic saturated or unsaturated (i.e., aromatic) group having from 3 to 10; from 4 to 8; or 5, 6, or 7 carbon atoms. Exemplary non-aromatic cyclic groups include cyclopropyl, cyclobutyl, cyclopentyl, cyclohexyl, and cyclooctyl. The term "heterocyclic group" includes optionally substituted, saturated or unsaturated, three- to eight-membered cyclic structures in which one or more skeletal atoms is oxygen, nitrogen, sulfur, or combinations thereof. Cyclic groups may be unsubstituted or substituted at one or more ring positions. A cyclic group may for example be substituted with halogens, alkyls, cycloalkyls, alkenyls, alkynyls, aryls, arylalkyls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, —CN. The cyclic group may also be linked to a substituent, such as halogens, alkyls, cycloalkyls, alkenyls, alkynyls, aryls, arylalkyls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, or —CN, by means of a saturated or unsaturated chain of 1, 2, 3, 4, 5, 6, 7, 8, or more carbon atoms; additionally one or more of the carbon atoms may be replaced with an oxygen, nitrogen, or sulfur atom. Other means of linking these groups are also possible.

In one embodiment of the invention, chemokines and chemokine analogs are designed by replacing all or part of the beta-sheet domain with a linker. In a different embodiment, all or a portion of the amino-terminal domain and all or a portion of the carboxy-terminal domain of a chemokine or chemokine analog are connected with a linker. In another embodiment, the chemokines and chemokine analogs are designed so that there are cyclized by covalent modification between residues of the peptide. In still other embodiments, the cysteines of the chemokines are replaced by other amino acids. In further embodiments, chemokines and chemokine analogs are modified by attaching modifying groups to the amino terminus.

Definitions

The term "heterocyclic group" includes cyclic saturated, unsaturated and aromatic groups having from 3 to 10; from 4 to 8; or 5, 6, or 7 carbon atoms, wherein the ring structure includes about one or more heteroatoms. Heterocyclic groups include pyrrolidine, oxolane, thiolane, imidazole, oxazole, piperidine, piperazine, morpholine. The heterocyclic ring may be substituted at one or more positions with such substituents as, for example, halogens, alkyls, cycloalkyls, alkenyls, alkynyls, aryls, arylalkyls, other heterocycles, hydroxyl, amino, nitro, thiol, amines, imines, amides, phosphonates, phosphines, carbonyls, carboxyls, silyls, ethers, thioethers, sulfonyls, selenoethers, ketones, aldehydes, esters, —$CF_3$, —CN. Heterocycles may also be bridged or fused to other cyclic groups as described below. A linker may also link the heterocyclic group to such substituents as, for example, halogens, alkyls, cycloalkyls, alkenyls, alkynyls, aryls, arylalkyls, heterocycles, hydroxyls, aminos, nitros, thiols amines, imines, amides, phosphonates, phosphines, carbonyls, carboxyls, silyls, ethers, thioethers, sulfonyls, sulfonates, selenoethers, ketones, aldehydes, esters, —$CF_3$, —CN.

The term "polycyclic group" as used herein is intended to refer to two or more saturated, unsaturated or aromatic cyclic rings in which two or more carbons are common to two adjoining rings, so that the rings are "fused rings." Rings that are joined through non-adjacent atoms are termed "bridged" rings. Each of the rings of the polycyclic group may be substituted with such substituents as described above, as for example, halogens, alkyls, cycloalkyls, alkenyls, alkynyls, hydroxyl, amino, nitro, thiol, amines, imines, amides, phosphonates, phosphines, carbonyls, carboxyls, silyls, ethers, thioethers, sulfonyls, selenoethers, ketones, aldehydes, esters, —$CF_3$, or —CN.

The term "alkyl" refers to a saturated aliphatic groups, including straight chain alkyl groups, branched-chain alkyl groups, cycloalkyl (alicyclic) groups, alkyl substituted cycloalkyl groups, and cycloalkyl substituted alkyl groups. In some embodiments, a straight chain or branched chain alkyl has 20 or fewer carbon atoms in its backbone ($C_1$–$C_{20}$ for straight chain, $C_3$–$C_{20}$ for branched chain), or 10 or fewer carbon atoms. In some embodiments, cycloalkyls may have from 4–10 carbon atoms in their ring structure, such as rings made from 5, 6 or 7. Unless the number of carbons is otherwise specified, "lower alkyl" as used herein means an alkyl group, as defined above, having from one to ten carbon atoms in its backbone structure. Likewise, "lower alkenyl" and "lower alkynyl" have chain lengths of ten or less carbons.

The term "alkyl" (or "lower alkyl") as used throughout the specification and claims is intended to include both "unsubstituted alkyls" and "substituted alkyls," the latter of which refers to alkyl moieties having substituents replacing a hydrogen on one or more carbons of the hydrocarbon backbone. Such substituents can include, for example, halogen, hydroxyl, carbonyl (such as carboxyl, ketones (including alkylcarbonyl and arylcarbonyl groups)), and esters (including alkyloxycarbonyl and aryloxycarbonyl groups), thiocarbonyl, acyloxy, alkoxyl, phosphoryl, phosphonate, phosphinate, amino, acylamino, amido, amidine, imino, cyano, nitro, azido, sulfhydryl, alkylthio, sulfate, sulfonate, sulfamoyl, sulfonamido, heterocyclyl, aralkyl, or an aromatic or heteroaromatic moiety. The moieties substituted on the hydrocarbon chain can themselves be substituted, if appropriate. For instance, the substituents of a substituted alkyl may include substituted and unsubstituted forms of aminos, azidos, iminos, amidos, phosphoryls (including phosphonates and phosphinates), sulfonyls (including sulfates, sulfonamidos, sulfamoyls and sulfonates), or silyl groups, as well as ethers, alkylthios, carbonyls (including ketones, aldehydes, carboxylates, and esters), —CF$_3$, —CN and the like. Exemplary substituted alkyls are described below. Cycloalkyls can be further substituted with alkyls, alkenyls, alkoxys, alkylthios, aminoalkyls, carbonyl-substituted alkyls, —CF3, —CN, and the like.

The terms "alkenyl" and "alkynyl" refer to unsaturated aliphatic groups analogous in length and possible substitution to the alkyls described above, but that contain at least one double or triple bond respectively.

The term "aralkyl," as used herein, refers to an alkyl or alkylenyl group substituted with at least one aryl group. Exemplary aralkyls include benzyl (i.e., phenylmethyl), 2-naphthylethyl, 2-(2-pyridyl)propyl, 5-dibenzosuberyl, and the like.

The term "alkylcarbonyl," as used herein, refers to —C(O)-alkyl. Similarly, the term "arylcarbonyl" refers to —C(O)-aryl. The term "alkyloxycarbonyl," as used herein, refers to the group —C(O)—O-alkyl, and the term "aryloxycarbonyl" refers to —C(O)—O-aryl. The term "acyloxy" refers to —O—C(O)—R$_7$, in which R$_7$ is alkyl, alkenyl, alkynyl, aryl, aralkyl or heterocyclyl.

The term "amino," as used herein, refers to —N(R$_\alpha$)(R$_\beta$), in which R$_\alpha$ and R$_\beta$ are each independently hydrogen, alkyl, alkenyl, alkynyl, aralkyl, aryl, or in which R$_\alpha$ and R$_\beta$ together with the nitrogen atom to which they are attached form a ring having 4–8 atoms. Thus, the term "amino," as used herein, includes unsubstituted, monosubstituted (e.g., monoalkylamino or monoarylamino), and disubstituted (e.g., dialkylamino or alkylarylamino) amino groups. The term "amido" refers to —C(O)—N(R$_\alpha$)(R$_\beta$), in which R$_\alpha$ and R$_\beta$ are as defined above. The term "acylamino" refers to —N(R'$_\alpha$)C(O)—R$_7$, in which R$_7$ is as defined above and R$_\alpha$ is alkyl.

As used herein, the term "nitro" means —NO$_2$; the term "halogen" designates —F, —Cl, —Br or —I; the term "sulflydryl" means —SH; and the term "hydroxyl" means —OH.

The term "aryl" as used herein includes 5-, 6- and 7-membered aromatic groups that may include from zero to four heteroatoms in the ring, for example, phenyl, pyrrolyl, furyl, thiophenyl, imidazolyl, oxazole, thiazolyl, triazolyl, pyrazolyl, pyridyl, pyrazinyl, pyridazinyl and pyrimidinyl, and the like. Those aryl groups having heteroatoms in the ring structure may also be referred to as "aryl heterocycles" or "heteroaromatics." The aromatic ring can be substituted at one or more ring positions with such substituents as described above, as for example, halogen, azide, alkyl, aralkyl, alkenyl, alkynyl, cycloalkyl, hydroxyl, amino, nitro, sulfhydryl, imino, amido, phosphonate, phosphinate, carbonyl, carboxyl, silyl, ether, alkylthio, sulfonyl, sulfonamido, ketone, aldehyde, ester, a heterocyclyl, an aromatic or heteroaromatic moiety, —CF$_3$, —CN, or the like. Aryl groups can also be part of a polycyclic group. For example, aryl groups include fused aromatic moieties such as naphthyl, anthracenyl, quinolyl, indolyl, and the like.

Modifying groups may also include groups comprising biochemical labels or structures, such as biotin, fluorescent-label-containing groups, light scattering or plasmon resonant particle, a diethylene-triaminepentaacetyl group, a (O)-menthoxyacetyl group, a N-acetylneuraminyl group, a cholyl structure or an iminobiotinyl group. A chemokine analog or chemokine mimetic compound may be modified at its carboxy terminus with a cholyl group according to methods known in the art. Cholyl derivatives and analogs may also be used as modifying groups. For example, a preferred cholyl derivative is Aic (3-(O-aminoethyl-iso)-cholyl), which has a free amino group that can be used to further modify the chemokine mimetic compound. A modifying group may be a "biotinyl structure," which includes biotinyl groups and analogues and derivatives thereof (such as a 2-iminobiotinyl group). In another embodiment, the modifying group may comprise a fluorescent-label group, e.g., a fluorescein-containing group, such as a group derived from reacting an IL-8, IP-10, MIP-1α, MCP-1, RANTES, I-309, and CCL28 derived peptidic structure with 5-(and 6-)-carboxyfluorescein, succinimidyl ester or fluorescein isothiocyanate. The chemokine analogs may also be modified by attaching other fluorescent labels including rhodamine, dichlorotriazinylamine fluorescein, dansyl chloride or phycoerythrin and energy transfer fluorescent dyes or fluorescent ion indicators. In various other embodiments, the modifying group(s) may comprise an N-acetylneuraminyl group, a trans-4-cotininecarboxyl group, a 2-imino-1-imidazolidineacetyl group, an (S)-(-)-indoline-2-carboxyl group, a (-)-menthoxyacetyl group, a 2-norbornaneacetyl group, a γ-oxo-5-acenaphthenebutyryl, a (-)-2-oxo-4-thiazolidinecarboxyl group, a tetrahydro-3-furoyl group, a 2-iminobiotinyl group, a diethylenetriaminepentaacetyl group, a 4-morpholinecarbonyl group, a 2-thiopheneacetyl group or a 2-thiophenesulfonyl group. In other embodiments, light scattering groups, magnetic groups, nanogold, other proteins, a solid matrix, radiolabels, or carbohydrates may be attached.

In still other aspects, the modifying group may be an oligomer, for example, polyethylene glycol, an oligonucleotide, a polypeptide (which may or may not be derived from a chemokine) or one moiety of a binding pair.

Functional Enhancement

A chemokine analog compound of the invention may be further modified to alter the specific properties of the compound while retaining the desired functionality of the compound. For example, in one embodiment, the compound may be modified to alter a pharmacokinetic property of the compound, such as in vivo stability, solubility, bioavailability or half-life. The compound may be modified to label the compound with a detectable substance. The compound may be modified to couple the compound to an additional therapeutic moiety. To further chemically modify the compound, such as to alter its pharmacokinetic properties, reactive groups can be derivatized. For example, when the modifying group is attached to the amino-terminal end of the IL-8, IP-10, MIP-1α, MCP-1, RANTES, I-309, and CCL28 core domain, the carboxy-terminal end of the compound may be further modified. Potential C-terminal modifications include those that reduce the ability of the compound to act as a substrate for carboxypeptidases. Examples of C-terminal modifiers include an amide group, an ethylamide group and various non-natural amino acids, such as D-amino acids, β-alanine, C-terminal decarboxylation, and a C-terminal alcohol. Alternatively, when the modifying group is attached to the carboxy-terminal end of the aggregation core domain, the amino-terminal end of the compound may be further modified, for example, to reduce the ability of the compound to act as a substrate for aminopeptidases.

Chemokines and chemokine analogs of the invention may be modified by the addition of polyethylene glycol (PEG). PEG modification may lead to improved circulation time, improved solubility, improved resistance to proteolysis, reduced antigenicity and immunogenicity, improved bioavailability, reduced toxicity, improved stability, and easier formulation (For a review see, Francis et al., International Journal of Hematology 68:1–18, 1998). PEGylation may also result in a substantial reduction in bioactivity.

The chemokine analogs of the invention may also be coupled to a radioisotope such as yttrium-90 or iodine-131 for therapeutic purposes (see, e.g., DeNardo et al., "Choosing an optimal radioimmunotherapy dose for clinical response," Cancer 94(4 Suppl): 1275–86, 2002; Kaltsas et al., "The value of radiolabelled MIBG and octreotide in the diagnosis and management of neuroendocrine tumours," Ann Oncol 12 Suppl 2:S47–50, 2001).

Detection Enhancement

A chemokine mimetic compound can be further modified to label the compound by reacting the compound with a detectable substance. In some aspects of the invention, suitable detectable substances include various enzymes, prosthetic groups, fluorescent materials, luminescent materials, light scattering or plasmon resonant materials, and radioactive materials. Examples of suitable enzymes include horseradish peroxidase, alkaline phosphatase, beta-galactosidase, or acetylcholinesterase. Examples of suitable prosthetic groups which are members of a binding pair and are capable of forming complexes include streptavidin/biotin, avidin/biotin and an antigen/antibody complex (e.g., rabbit IgG and anti-rabbit IgG). Examples of suitable fluorescent materials include umbelliferone, fluorescein, fluorescein isothiocyanate, rhodamine, dichlorotriazinylamine fluorescein, dansyl chloride or phycoerythrin and energy transfer fluorescent dyes. An example of a luminescent material includes luminol. Examples of light scattering or plasmon resonant materials include gold or silver particles and quantum dots. Examples of suitable radioactive material include $^{14}C$, $^{123}I$, $^{124}I$, $^{125}I$, $^{131}I$, Tc99m, $^{35}S$ or $^{3}H$. A chemokine mimetic compound may be radioactively labeled with $^{14}C$, either by incorporation of $^{14}C$ into the modifying group or one or more amino acid structures in the chemokine mimetic compound. Labeled chemokine mimetic compounds may be used to assess the in vivo pharmacokinetics of the compounds, as well as to detect disease progression or propensity of a subject to develop a disease, for example for diagnostic purposes. Tissue distribution chemokine receptors can be detected using a labeled chemokine mimetic compound either in vivo or in an in vitro sample derived from a subject. For use as an in vivo diagnostic agent, a chemokine mimetic compound of the invention may be labeled with radioactive technetium or iodine. A modifying group can be chosen that provides a site at which a chelation group for the label can be introduced, such as the Aic derivative of cholic acid, which has a free amino group. For example, a tyrosine residue within the IL-8, IP-10, MIP-1α, MCP-1, RANTES, I-309, and CCL28 sequence may be substituted with radioactive iodotyrosyl. Any of the various isotopes of radioactive iodine may be incorporated to create a diagnostic or therapeutic agent. $^{123}I$ (half-life=13.2 hours) may be used for whole body scintigraphy, $^{124}I$ (half life=4 days) may be used for positron emission tomography (PET), $^{125}I$ (half life=60 days) may be used for metabolic turnover studies and $^{131}I$ (half life=8 days) may be used for whole body counting and delayed low resolution imaging studies.

Prodrug

In an alternative chemical modification, a chemokine analog compound of the invention may be prepared in a "prodrug" form, wherein the compound itself does not act as a chemokine analog agonist, but rather is capable of being transformed, upon metabolism in vivo, into a chemokine analog agonist or antagonist compound as defined herein. For example, in this type of compound, the modifying group can be present in a prodrug form that is capable of being converted upon metabolism into the form of an active chemokine analog agonist. Such a prodrug form of a modifying group is referred to herein as a "secondary modifying group." A variety of strategies are known in the art for preparing peptide prodrugs that limit metabolism in order to optimize delivery of the active form of the peptide-based drug.

Synthesis

Chemokine analog compounds of the invention may be prepared by standard techniques known in the art. A peptide or polypeptide component of a chemokine analog may comprise, at least in part, a peptide synthesized using standard techniques (such as those described by Clark-Lewis, I., Dewald, B., Loetscher, M., Moser, B., and Baggiolini, M., (1994) J. Biol. Chem., 269, 16075–16081). Automated peptide synthesizers are commercially available (e.g., Advanced ChemTech Model 396; Milligen/Biosearch 9600, Appliedbiosystems/Pioneer). Peptides and polypeptides may be assayed for chemokine receptor agonist or antagonist activity in accordance with standard methods. Peptides and polypeptides may be purified by HPLC and analyzed by mass spectrometry. Peptides and polypeptides may be dimerized. In one embodiment, peptides and polypeptides are dimerized via a disulfide bridge formed by gentle oxidation of the cysteines using 10% DMSO in water. Following HPLC purification, dimer formation may be verified, by mass spectrometry. One or more modifying groups may be attached to a MCP-1, RANTES, IL-8, IP-10, MIP-1α, I-309, or CCL28-derived peptidic component by standard methods, for example, using methods for reaction through an amino group (e.g., the alpha-amino group at the amino-terminus of a peptide), a carboxyl group (e.g., at the carboxy terminus of a peptide), a hydroxyl group (e.g., on a tyrosine, serine or threonine residue) or other suitable reactive group on an amino acid side chain.

In alternative embodiments, analogs derived from the C-terminal and N-terminal joined by a linker could be cyclized in their C-terminal moiety using side-chain to side-chain; side-chain to scaffold or, scaffold to scaffold cyclization. In some embodiments, lactamization, etherification, or RCM (Ring Closing Methatesis) are used to carry out this reaction.

For instance, chemokine analogs may be cyclized using a lactam formation procedure by joining the γ-carboxy side chain or the α-carboxy moiety of glutamate (Glu) residue to the ε-amino side chain of lysine (Lys) residue, as indicated in the following sequences by underlining of linked residues. Lactams may for example be formed between glutamic acid and lysine (Lys) in the C-terminal portion of the polypeptide (which does not correspond necessarily with the numbering of that residue in the native sequence). In further alternatives, a lysine (Lys) may be substituted by ornithine (Orn) or any other (L or D) natural or (L or D) non-natural amino acid having an amino group on its side chain. Similarly, glutamate (Glu) may for example be substituted with aspartate (Asp), denoted by nomenclature such as (Glu->Asp) indicating a substitution in a given position in the peptide wherein aspartate replaces glutamate.

The chemokine analogs of the invention include chemokine polypeptide sequences wherein one or more of the amino acids have been replaced by a conservative amino acid substitution. The term "conservative amino acid substitution" refers to a polypeptide chain in which one of the amino acid residues is replaced with an amino acid residue having a side chain with similar properties. Families of amino acid residues having side chains with similar properties are well known in the art. These families include amino acids with acidic side chains (e.g., aspartic acid, glutamic acid), basic side chains (e.g., lysine, arginine, histidine), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, an amino acid residue in a chemokine is replaced with another amino acid residue from the same side chain family.

Recombinant Synthesis

Chemokines, chemokine fragments, or chemokine analogs may also be synthesized, in whole or in part, by recombinant methods using expression vectors encoding all or part of a chemokine.

Vectors, or preferably expression vectors, may contain a gene encoding a polypeptide of the invention, a functional derivative thereof, or another useful polypeptide. These vectors may be employed to express the encoded polypeptide in either prokaryotic or eukaryotic cells.

The term "vector" in this application refers to a DNA molecule into which another DNA of interest can be inserted by incorporation into the DNA of the vector. One skilled in the art is familiar with the term. Examples of classes of vectors can be plasmids, cosmids, viruses, and bacteriophage. Typically, vectors are designed to accept a wide variety of inserted DNA molecules and then used to transfer or transmit the DNA of interest into a host cell (e.g., bacterium, yeast, higher eukaryotic cell). A vector may be chosen based on the size of the DNA molecule to be inserted, as well as based on the intended use. For transcription into RNA or transcription followed by translation to produce an encoded polypeptide, an expression vector would be chosen. For the preservation or identification of a specific DNA sequence (e.g., one DNA sequence in a cDNA library) or for producing a large number of copies of the specific DNA sequence, a cloning vector would be chosen. If the vector is a virus or bacteriophage, the term vector may include the viral/bacteriophage coat.

Following entry into a cell, all or part of the vector DNA, including the insert DNA, may be incorporated into the host cell chromosome, or the vector may be maintained extrachromosomally. Those vectors that are maintained extrachromosomally are frequently capable of autonomous replication in a host cell into which they are introduced (e.g., many plasmids having a bacterial origin of replication). Other vectors are integrated into the genome of a host cell upon introduction into the host cell, and thereby are replicated along with the host genome.

The term "expression vector" refers to a DNA construct which allows one to place a gene encoding a gene product of interest, usually a protein, into a specific location in a vector from which the selected gene product can be expressed by the machinery of the host cell, or alternately, by in vitro expression system. This type of vector is frequently a plasmid, but other forms of expression vectors, such as bacteriophage vectors and viral vectors (e.g., adenoviruses, replication defective retroviruses, and adeno-associated viruses), may be employed. The selection of expression vectors, control sequences, transformation methods, and the like, are dependent on the type of host cell used to express the gene.

Prokaryotic Hosts

Prokaryotic hosts are, in generally, very efficient and convenient for the production of recombinant polypeptides and are, therefore, one type of preferred expression system. Prokaryotes most frequently are represented by various strains of E. coli, but other microbial strains may be used, including other bacterial strains. Recognized prokaryotic hosts include bacteria such as E. coli, Bacillus, Streptomyces, Pseudomonas, Salmonella, Serratia, and the like. However, under such conditions, recombinantly-produced polypeptides will not be glycosylated.

In prokaryotic systems, vectors that contain replication sites and control sequences derived from a species compatible with the host may be used. Preferred prokaryotic vectors include plasmids such as those capable of replication in E. coli (such as, for example, pBR322, ColEl, pSC101, pACYC 184, pVX, pUC118, pUC119 and the like). Suitable phage or bacteriophage vectors may include λgt10, λgt11, vectors derived from filamentous bacteriophage such as m13, and the like. Suitable Streptomyces plasmids include p1J101, and streptomyces bacteriophages such as fC31. Bacillus plasmids include pC194, pC221, pT127, and the like. Suitable Pseudomonas plasmids have been reviewed by Izaki (Jpn. J. Bacteriol. 33:729–742, 1978) and John et al. (Rev. Infect. Dis. 8:693–704, 1986).

To express a protease of the invention (or a functional derivative thereof) in a prokaryotic cell, it is necessary to operably link the sequence encoding the protease of the invention to a functional prokaryotic promoter. Such promoters are either constitutive or inducible promoters, but commonly inducible promoters are used. Examples of constitutive promoters include the int promoter of bacteriophage λ, the bla promoter of the β-lactamase gene sequence of pBR322, and the cat promoter of the chloramphenicol acetyl transferase gene sequence of pPR325, and the like. Examples of inducible prokaryotic promoters include the major right and left promoters of bacteriophage λ (PL and PR), the trp, recA, lacZ, lac, and gal promoters of E. coli, the α-amylase and the V-28-specific promoters of B. subtilis, the promoters of the bacteriophages of Bacillus, and Streptomyces promoters. Prokaryotic promoters are reviewed by Glick (Ind. Microbiot. 1:277–282, 1987), Cenatiempo (Biochimie 68:505–516, 1986), and Gottesman (Ann. Rev. Genet. 18:415–442, 1984). Additionally, proper expression in a prokaryotic cell also requires the presence of a ribosome-binding site upstream of the encoding sequence. Such ribosome-binding sites are disclosed, for example, by Gold et al. (Ann. Rev. Microbiol. 35:365–404, 1981).

Fusion Protein

Proteins may be expressed as fusion proteins. Genes for proteins expressed as fusion proteins ligated into expression vectors that add a number of amino acids to a protein encoded and expressed, usually to the amino terminus of the recombinant protein. Such a strategy of producing fusion proteins is usually adopted for three purposes: (1) to assist in the purification by acting as a ligand in affinity purification, (2) to increase the solubility of the product, and (3) to increase the expression of the product. Often, expression vectors for use in fusion protein production, a proteolytic cleavage site is included at the junction of the fusion region and the protein of interest to enable purification of the recombinant protein away from the fusion region following affinity purification of the fusion protein. Such enzymes, and their cognate recognition sequences, include Factor Xa, thrombin and enterokinase, and may also include trypsin or chymotrypsin. Typical fusion expression vectors include pGEX (Pharmacia Biotech Inc; Smith, D. B. and Johnson, K. S. (1988) Gene 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Improving Yield

Maximizing recombinant protein expression in *E. coli* can be assisted by expressing the protein or fusion protein in a host bacteria with an impaired proteolytic system so as to reduce the post-synthesis degradation of the recombinant protein (Gottesman, S., Gene Expression Technology: Methods in Enzymology 185, Academic Press, San Diego, Calif. (1990) 119–128). Another strategy is to alter the mix of codons used in the coding sequence to reflect the usage of the individual codons for each amino acid in the host (e.g., *E. coli* (Wada et al., (1992) Nucleic Acids Res. 20:2111–2118)). Such alteration of nucleic acid sequences of the invention can be carried out by standard DNA synthesis techniques and may prove useful for a variety of prokaryotic and eukaryotic expression systems.

Eukaryotic Hosts

Suitable hosts may include eukaryotic cells. Preferred eukaryotic hosts include, for example, yeast, fungi, insect cells, and mammalian cells both in vivo and in tissue culture. Useful mammalian cell hosts include HeLa cells, cells of fibroblast origin such as VERO or CHO-K1, and cells of lymphoid origin and their derivatives. Preferred mammalian host cells include SP2/0 and J558L, as well as neuroblastoma cell lines such as IMR 332, which may provide better capacities for correct post-translational processing. In general, eukaryotic organisms such as yeast provide substantial advantages in that they can also carry out post-translational modifications.

A large number of yeast expression systems may be potentially utilized which incorporate promoter and termination elements from the actively expressed sequences coding for glycolytic enzymes. These expression systems produce in large quantities of proteins when yeast are grown in mediums rich in glucose. Known glycolytic gene sequences can also provide very efficient transcriptional control signals. A number of recombinant DNA strategies exist utilizing strong promoter sequences and high copy number plasmids which can be utilized for production of the desired proteins in yeast. Examples of vectors suitable for expression in *S. cerivisae* include pYepSec1 (Baldari, et al., (1987) Embo J. 6:229–234), pMFa (Kurjan and Herskowitz, (1982) Cell 30:933–943), pJRY88 (Schultz et al., (1987) Gene 54:113–123), pYES2 (In Vitrogen Corporation, San Diego, Calif.), and picZ (In Vitrogen Corp, San Diego, Calif.).

In another embodiment, the protein of interest may be expressed in insect cells for example the *Drosophila* larvae. Using insect cells as hosts, the *Drosophila* alcohol dehydrogenase promoter may be used (Rubin, Science 240:1453–1459, 1988). Additionally, baculovirus vectors can be engineered to express large amounts of the protein of interest in cultured insect cells (e.g., Sf9 cells)(Jasny, Science 238:1653, 1987; Miller et al., in: Genetic Engineering, Vol. 8, Plenum, Setlow et al., eds., pp. 277–297, 1986). Vectors which may be used include the pAc series (Smith et al. (1983) Mol. Cell Biol. 3:2156–2165) and the pVL series (Lucklow and Summers (1989) Virology 170:31–39).

Plant cells may also be utilized as hosts, and control sequences compatible with plant cells are available, such as the cauliflower mosaic virus 35S and 19S promoters, and nopaline synthase promoter and polyadenylation signal sequences. Furthermore, the protein of interest may be expressed in plants which have incorporated the expression vector into their germ line.

In yet another embodiment, a nucleic acid of the invention may be expressed in mammalian cells using a mammalian expression vector. Possibilities and techniques for expression in mammalian cells has recently been summarized (Colosimo, et al., "Transfer and expression of foreign genes in mammalian cells," Biotechniques 29(2):314–8, 320–2, 324 passim, 2000; which is hereby incorporated by reference in its entirety including any drawings, tables, and figures.). Examples of mammalian expression vectors include pCDM8 (Seed, B. (1987) Nature 329:840) and pMT2PC (Kaufman et al. (1987) EMBO J. 6:187–195). For use in mammalian cells, the regulatory sequences of the expression vector are often derived from viral regulatory elements. For example, commonly used promoters are derived from Simian Virus 40 (SV40), polyoma, Adenovirus 2, and cytomegalovirus (CMV) viruses. Preferred eukaryotic promoters include, for example, the promoter of the mouse metallothionein I gene sequence (Hamer et al., J. Mol. Appl. Gen. 1:273–288, 1982); the TK promoter of Herpes virus (McKnight, Cell 31:355–365, 1982); the SV40 early promoter (Benoist et al., Nature (London) 290:304–31, 1981); and the yeast gal4 gene sequence promoter (Johnston et al., Proc. Natl. Acad. Sci. (USA) 79:6971–6975, 1982; Silver et al., Proc. Natl. Acad. Sci. (USA) 81:5951–5955, 1984). Alternatively, promoters from mammalian expression products, such as actin, collagen, myosin, and the like, may be employed. Regulatory elements may also be derived from adenovirus, bovine papilloma virus, cytomegalovirus, simian virus, or the like.

Transcriptional initiation regulatory signals may be selected which allow for repression or activation, so that expression of the gene sequences can be modulated. Of interest are regulatory signals which are temperature-sensitive so that by varying the temperature, expression can be repressed or initiated, or are subject to chemical (such as metabolite) regulation. Expression of proteins of interest in eukaryotic hosts requires the use of eukaryotic regulatory regions. Such regions will, in general, include a promoter region sufficient to direct the initiation of RNA synthesis.

The recombinant mammalian expression vector may also be designed to be capable of directing expression of the nucleic acid preferentially in a particular cell type (i.e., tissue-specific regulatory elements are used to control the expression). Such tissue-specific promoters include the liver-specific albumin promoter (Pinkert et al. (1987) Genes Dev. 1:268–277); lymphoid-specific promoters (e.g., Calame and Eaton (1988) Adv. Immunol. 43:235–275), and in particular promoters of immunoglobulins and T cell receptors (Winoto and Baltimore (1989) EMBO J. 8:729–733, Banerji et al. (1983) Cell 33:729–740; Queen and Baltimore (1983) Cell 33:741–748); mammary gland-specific promoters (e.g., milk whey promoter; U.S. Pat. No. 4,873,316 and European Application Publication No. 264, 166); and pancreas-specific promoters (Edlund et al. (1985) Science 230:912–916). Developmentally-regulated promoters may also be utilized, for example, the α-fetoprotein promoter (Campes and Tilghman (1989) Genes Dev. 3:537–546), and the murine hox promoters (Kessel and Gruss (1990) Science 249:374–379).

Preferred eukaryotic plasmids include, for example, SV40, BPV, pMAM-neo, pKRC, vaccinia, 2-micron circle, and the like, or their derivatives. Such plasmids are well known in the art (Botstein et al., Miami Wntr. Symp. 19:265–274, 1982; Broach, In: "The Molecular Biology of the Yeast *Saccharomyces:* Life Cycle and Inheritance," Cold Spring Harbor Laboratory, Cold Spring Harbor, N.Y., p. 445–470, 1981; Broach, Cell 28:203–204, 1982; Bollon et al., J. Clin. Hematol. Oncol. 10:39–48, 1980; Maniatis, In: Cell Biology: A Comprehensive Treatise, Vol. 3, Gene Sequence Expression, Academic Press, NY, pp. 563–608, 1980).

Once the vector or nucleic acid molecule containing the construct(s) has been prepared for expression, the DNA construct(s) may be introduced into an appropriate host cell by any of a variety of suitable means, i.e., transformation, transfection, conjugation, protoplast fusion, electroporation, particle gun technology, DEAE-dextran-mediated transfection, lipofection, calcium phosphate-precipitation, direct microinjection, and the like. Suitable methods for transforming or transfecting host cells can be found in Sambrook, et al. (2001). After the introduction of the vector, recipient cells are grown in a selective medium, which selects for the growth of vector-containing cells. Expression of the cloned gene(s) results in the production of a protein of interest, or fragments thereof.

For other suitable expression systems for both prokaryotic and eukaryotic cells see Sambrook, et al., "Molecular Cloning: A Laboratory Manual," 3rd ed., Cold Spring Harbor Laboratory, Cold Spring Harbor Laboratory Press, Cold Spring Harbor, N.Y., 2001, which is hereby incorporated by reference in its entirety, including any drawings, figures, and tables.

For transformation of eukaryotic cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin, neomycin, methotrexate, glyphosate, and bialophos. Nucleic acid encoding a selectable marker can be introduced into a host cell on the same vector as that encoding the protein of interest or can be introduced on a separate vector. Cells stably transformed with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) the protein of interest. Accordingly, the invention further provides methods for producing the protein of interest using the host cells of the invention. In one embodiment, the method comprises culturing the host cell into which a recombinant expression vector encoding the protein of interest has been introduced in a suitable medium such that the protein of interest is produced, and may be purified by one skilled in the art.

In some aspects of the chemokine analogs of the invention, the analogs contain a linker, having the denoted structure [linker] (shown in bold), wherein the linker has the following structure: $H_2N-Z_4-COOH$ as defined below.

IL-8 Compounds

In one aspect of this invention, the chemokine analogs contain linear IL-8 analogs of the present invention corresponding to a portion of the N-terminal of IL-8 having the following structures:

```
IL-8-1(1-15) acid or amide
a1)   RNH-Ser-Ala-Lys-Glu-Leu-Arg-Cys-Gln-Cys-Ile-Lys-Thr-Tyr-Ser-Lys-(OH)NH₂      (SEQ ID NO:9)

a2)   RNH-Ser-Ala-Lys-Glu-Leu-Arg-Xaa₁-Gln-Xaa₂-Ile-Lys-Thr-Tyr-Ser-Lys-(OH)NH₂   (SEQ ID NO:10)

a3)   RNH-Xaa₃-Ala-Lys-Glu-Leu-Arg-Xaa₁-Gln-Xaa₂-Ile-Lys-Thr-Tyr-Ser-Lys-(OH)NH₂  (SEQ ID NO:11)

a4)   RNH-Ser-Xaa₃-Lys-Glu-Leu-Arg-Xaa₁-Gln-Xaa₂-Ile-Lys-Thr-Tyr-Ser-Lys-(OH)NH₂  (SEQ ID NO:12)

a5)   RNH-Ser-Ala-Xaa₃-Glu-Leu-Arg-Xaa₁-Gln-Xaa₂-Ile-Lys-Thr-Tyr-Ser-Lys-(OH)NH₂  (SEQ ID NO:13)

IL-8-1(1-13) acid or amide
a6)   RNH-Ser-Ala-Lys-Glu-Leu-Arg-Cys-Gln-Cys-Ile-Lys-Thr-Tyr-(OH)NH₂             (SEQ ID NO:14)

a7)   RNH-Ser-Ala-Lys-Glu-Leu-Arg-Xaa₁-Gln-Xaa₂-Ile-Lys-Thr-Tyr-(OH)NH₂           (SEQ ID NO:15)

a8)   RNH-Xaa₃-Ala-Lys-Glu-Leu-Arg-Xaa₁-Gln-Xaa₂-Ile-Lys-Thr-Tyr-(OH)NH₂          (SEQ ID NO:16)

a9)   RNH-Ser-Xaa₃-Lys-Glu-Leu-Arg-Xaa₁-Gln-Xaa₂-Ile-Lys-Thr-Tyr-(OH)NH₂          (SEQ ID NO:17)

a10)  RNH-Ser-Ala-Xaa₃-Glu-Leu-Arg-Xaa₁-Gln-Xaa₂-Ile-Lys-Thr-Tyr-(OH)NH₂          (SEQ ID NO:18)

IL-8-1(1-11) acid or amide
a11)  RNH-Ser-Ala-Lys-Glu-Leu-Arg-Cys-Gln-Cys-Ile-Lys-(OH)NH2                     (SEQ ID NO:19)

a12)  RNH-Ser-Ala-Lys-Glu-Leu-Arg-Xaa₁-Gln-Xaa₂-Ile-Lys-(OH)NH2                   (SEQ ID NO:20)

a13)  RNH-Xaa₃-Ala-Lys-Glu-Leu-Arg-Xaa₁-Gln-Xaa₂-Ile-Lys-(OH)NH2                  (SEQ ID NO:21)

a14)  RNH-Ser-Xaa₃-Lys-Glu-Leu-Arg-Xaa₁-Gln-Xaa₂-Ile-Lys-(OH)NH2                  (SEQ ID NO:22)

a15)  RNH-Ser-Ala-Xaa₃-Glu-Leu-Arg-Xaa₁-Gln-Xaa₂-Ile-Lys-(OH)NH2                  (SEQ ID NO:23)
```

Preferred embodiments of linear IL-8 analogs of the present invention corresponding to a portion of the internal-region of IL-8 having the following structures:

```
[A⁹]-IL-8-1(9-33) acid or amide
a16)  RNH-Ala-Ile-Lys-Thr-Tyr-Ser-      (SEQ ID NO:24)
      Lys-Pro-Phe-His-Pro-Lys-Phe-
```

-continued

```
        Ile-Lys-Glu-Leu-Arg-Val-Ile-
        Glu-Ser-Gly-Pro-His-(OH)NH₂

[A³⁴]-IL-8-1(34-49) acid or amide
a17)    RNH-Ala-Ala-Asn-Thr-Glu-Ile-        (SEQ ID NO:25)
        Ile-Val-Lys-Leu-Ser-Asp-Gly-
        Arg-Glu-Leu-(OH)NH₂
```

Preferred embodiments of linear IL-8 analogs of the present invention corresponding to a portion of the C-terminal of IL-8 having the following structures:

```
IL-8-1(51-72) acid or amide
a18)    RNH-Leu-Asp-Pro-Lys-Glu-Asn-        (SEQ ID NO:26)
        Trp-Val-Gln-Arg-Val-Val-Glu-
        Lys-Phe-Leu-Lys-Arg-Ala-Glu-
        Asn-Ser-(OH)NH₂
```

Preferred embodiments of linear IL-8 analogs of the present invention corresponding to a portion of the N-terminal joined with a linker to the C-terminal region of IL-8 having the following structures:

```
IL-8-1(1-15)-[linker]-IL-8-(56-71)-acid or amide
a19)    RNH-Ser-Ala-Lys-Glu-Leu-Arg-Cys-Gln-Cys-Ile-Lys-Thr-Tyr-Ser-Lys-[linker]-Asn-        (SEQ ID NO:27)
        Trp-Val-Gln-Arg-Val-Val-Glu-Lys-Phe-Leu-Lys-Arg-Ala-Glu-Asn-(OH)NH₂ a20)    RNH-Ser-Ala-Lys-Glu-Leu-Arg-Xaa₁-Gln-Xaa₂-Ile-Lys-Thr-Tyr-Ser-Lys-[linker]-Asn-     (SEQ ID NO:28)
        Trp-Val-Gln-Arg-Val-Val-Glu-Lys-Phe-Leu-Lys-Arg-Ala-Glu-Asn-(OH)NH₂ a22)    RNH-Xaa₃-Ala-Lys-Glu-Leu-Arg-Xaa₁-Gln-Xaa₂-Ile-Lys-Thr-Tyr-Ser-Lys-[linker]-        (SEQ ID NO:29)
        Asn-Trp-Val-Gln-Arg-Val-Val-Glu-Lys-Phe-Leu-Lys-Arg-Ala-Glu-Asn-(OH)NH₂ a23)    RNH-Ser-Xaa₃-Lys-Glu-Leu-Arg-Xaa₁-Gln-Xaa₂-Ile-Lys-Thr-Tyr-Ser-Lys-[linker]-        (SEQ ID NO:30)
        Asn-Trp-Val-Gln-Arg-Val-Val-Glu-Lys-Phe-Leu-Lys-Arg-Ala-Glu-Asn-(OH)NH₂ a24)    RNH-Ser-Ala-Xaa₃-Glu-Leu-Arg-Xaa₁-Gln-Xaa₂-Ile-Lys-Thr-Tyr-Ser-Lys-[linker]-        (SEQ ID NO:31)
        Asn-Trp-Val-Gln-Arg-Val-Val-Glu-Lys-Phe-Leu-Lys-Arg-Ala-Glu-Asn-(OH)NH₂ a25)    RNH-Ser-Ala-Lys-Glu-Leu-Arg-Xaa₁-Gln-Xaa₂-Xaa₂-Lys-Thr-Tyr-Ser-Lys-[linker]-        (SEQ ID NO:32)
        Asn-Trp-Val-Gln-Arg-Val-Val-Glu-Lys-Phe-Leu-Lys-Arg-Ala-Glu-Asn-(OH)NH₂ a26)    RNH-Xaa₃-Ala-Lys-Glu-Leu-Arg-Xaa₁-Gln-Xaa₂-Xaa₄-Lys-Thr-Tyr-Ser-Lys-[linker]-       (SEQ ID NO:33)
        Asn-Trp-Val-Gln-Arg-Val-Val-Glu-Lys-Phe-Leu-Lys-Arg-Ala-Glu-Asn-(OH)NH₂ a27)    RNH-Ser-Xaa₃-Lys-Glu-Leu-Arg-Xaa₁-Gln-Xaa₂-Xaa₄-Lys-Thr-Tyr-Ser-Lys-[linker]-       (SEQ ID NO:34)
        Asn-Trp-Val-Gln-Arg-Val-Val-Glu-Lys-Phe-Leu-Lys-Arg-Ala-Glu-Asn-(OH)NH₂ a28)    RNH-Ser-Ala-Xaa₃-Glu-Leu-Arg-Xaa₁-Gln-Xaa₂-Xaa₄-Lys-Thr-Tyr-Ser-Lys-[linker]-       (SEQ ID NO:35)
        Asn-Trp-Val-Gln-Arg-Val-Val-Glu-Lys-Phe-Leu-Lys-Arg-Ala-Glu-Asn-(OH)NH₂ a29)    RNH-Ser-Ala-Lys-Glu-Leu-Arg-Xaa₁-Gln-Xaa₂-Ile-Xaa₄-Thr-Tyr-Ser-Lys-[linker]-        (SEQ ID NO:36)
        Asn-Trp-Val-Gln-Arg-Val-Val-Glu-Lys-Phe-Leu-Lys-Arg-Ala-Glu-Asn-(OH)NH₂ a30)    RNH-Xaa₃-Ala-Lys-Glu-Leu-Arg-Xaa₁-Gln-Xaa₂-Ile-Xaa₄-Thr-Tyr-Ser-Lys-[linker]-       (SEQ ID NO:37)
        Asn-Trp-Val-Gln-Arg-Val-Val-Glu-Lys-Phe-Leu-Lys-Arg-Ala-Glu-Asn-(OH)NH₂ a31)    RNH-Ser-Xaa₃-Lys-Glu-Leu-Arg-Xaa₁-Gln-Xaa₂-Ile-Xaa₄-Thr-Tyr-Ser-Lys-[linker]-       (SEQ ID NO:38)
        Asn-Trp-Val-Gln-Arg-Val-Val-Glu-Lys-Phe-Leu-Lys-Arg-Ala-Glu-Asn-(OH)NH₂ a32)    RNH-Ser-Ala-Xaa₃-Glu-Leu-Arg-Xaa₁-Gln-Xaa₂-Ile-Xaa₄-Thr-Tyr-Ser-Lys-[linker]-       (SEQ ID NO:39)
        Asn-Trp-Val-Gln-Arg-Val-Val-Glu-Lys-Phe-Leu-Lys-Arg-Ala-Glu-Asn-(OH)NH₂ a33)    RNH-Ser-Ala-Lys-Glu-Leu-Arg-Xaa₁-Gln-Xaa₂-Ile-Lys-Xaa₄-Tyr-Ser-Lys-[linker]-        (SEQ ID NO:40)
        Asn-Trp-Val-Gln-Arg-Val-Val-Glu-Lys-Phe-Leu-Lys-Arg-Ala-Glu-Asn-(OH)NH₂ a34)    RNH-Xaa₃-Ala-Lys-Glu-Leu-Arg-Xaa₁-Gln-Xaa₂-Ile-Lys-Xaa₄-Tyr-Ser-Lys-[linker]-       (SEQ ID NO:41)
        Asn-Trp-Val-Gln-Arg-Val-Val-Glu-Lys-Phe-Leu-Lys-Arg-Ala-Glu-Asn-(OH)-NH₂ a35)    RNH-Ser-Xaa₃-Lys-Glu-Leu-Arg-Xaa₁-Gln-Xaa₂-Ile-Lys-Xaa₄-Tyr-Ser-Lys-[linker]-       (SEQ ID NO:42)
        Asn-Trp-Val-Gln-Arg-Val-Val-Glu-Lys-Phe-Leu-Lys-Arg-Ala-Glu-Asn-(OH)NH₂ a36)    RNH-Ser-Ala-Xaa₃-Glu-Leu-Arg-Xaa₁-Gln-Xaa₂-Ile-Lys-Xaa₄-Tyr-Ser-Lys-[linker]-       (SEQ ID NO:43)
        Asn-Trp-Val-Gln-Arg-Val-Val-Glu-Lys-Phe-Leu-Lys-Arg-Ala-Glu-Asn-(OH)NH₂ a37)    RNH-Ser-Ala-Lys-Glu-Leu-Arg-Xaa₁-Gln-Xaa₂-Ile-Lys-Thr-Xaa₄-Ser-Lys-[linker]-        (SEQ ID NO:44)
        Asn-Trp-Val-Gln-Arg-Val-Val-Glu-Lys-Phe-Leu-Lys-Arg-Ala-Glu-Asn(OH)NH₂ a38)    RNH-Xaa₃-Ala-Lys-Glu-Leu-Arg-Xaa₁--Gln-Xaa₂-Ile-Lys-Thr-Xaa₄-Ser-Lys-[linker]-      (SEQ ID NO:45)
        Asn-Trp-Val-Gln-Arg-Val-Val-Glu-Lys-Phe-Leu-Lys-Arg-Ala-Glu-Asn(OH)NH₂ a39)    RNH-Ser-Xaa₃-Lys-Glu-Leu-Arg-Xaa₁-Gln-Xaa₂-Ile-Lys-Thr-Xaa₄-Ser-Lys-[linker]-       (SEQ ID NO:46)
        Asn-Trp-Val-Gln-Arg-Val-Val-Glu-Lys-Phe-Leu-Lys-Mg-Ala-Glu-Asn(OH)NH₂ a40)    RNH-Ser-Ala-Xaa₃-Glu-Leu-Arg-Xaa₁-Gln-Xaa₂-Ile-Lys-Thr-Xaa₄-Ser-Lys-[linker]-       (SEQ ID NO:47)
        Asn-Trp-Val-Gln-Arg-Val-Val-Glu-Lys-Phe-Leu-Lys-Arg-Ala-Glu-Asn(OH)NH₂
```

| | | |
|---|---|---|
| a41) | RNH-Ser-Ala-Lys-Glu-Leu-Arg-Xaa$_1$-Gln-Xaa$_2$-Ile-Lys-Thr-Tyr-Xaa$_4$-Lys-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:48) |
| a42) | RNH-Xaa$_3$-Ala-Lys-Glu-Leu-Arg-Xaa$_1$-Gln-Xaa$_2$-Ile-Lys-Thr-Tyr-Xaa$_4$-Lys-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:49) |
| a43) | RNH-Ser-Xaa$_3$-Lys-Glu-Leu-Arg-Xaa$_1$-Gln-Xaa$_2$-Ile-Lys-Thr-Tyr-Xaa$_4$-Lys-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:50) |
| a44) | RNH-Ser-Ala-Xaa$_3$-Glu-Leu-Arg-Xaa$_1$-Gln-Xaa$_2$-Ile-Lys-Thr-Tyr-Xaa$_5$-Lys-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:51) |
| a45) | RNH-Ser-Ala-Lys-Glu-Leu-Arg-Xaa$_1$-Gln-Xaa$_2$-Ile-Lys-Thr-Tyr-Ser-Xaa$_4$-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:52) |
| a46) | RNH-Xaa$_3$-Ala-Lys-Glu-Leu-Arg-Xaa$_1$-Gln-Xaa$_2$-Ile-Lys-Thr-Tyr-Ser-Xaa$_4$-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:53) |
| a47) | RNH-Ser-Xaa$_3$-Lys-Glu-Leu-Arg-Xaa$_1$-Gln-Xaa$_2$-Ile-Lys-Thr-Tyr-Ser-Xaa$_4$-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:54) |
| a48) | RNH-Ser-Ala-Xaa$_3$-Glu-Leu-Arg-Xaa$_1$-Gln-Xaa$_2$-Ile-Lys-Thr-Tyr-Ser-Xaa$_4$-[linker]-<br>Asn-Trp-Val-Gln-Arg-Val-Val-Glu-Lys-Phe-Leu-Lys-Arg-Ala-Glu-Asn-(OH)NH$_2$ | (SEQ ID NO:55) |

IL-8-1(1-13)-[linker]-IL-8-(56-71)-acid or amide

| | | |
|---|---|---|
| a49) | RNH-Ser-Ala-Lys-Glu-Leu-Arg-Cys-Gln-Cys-Ile-Lys-Thr-Tyr-[linker]-Asn-Trp-Val-<br>Gln-Arg-Val-Val-Glu-Lys-Phe-Leu-Lys-Arg-Ala-Glu-Asn-(OH)NH$_2$ | (SEQ ID NO:56) |
| a50) | RNH-Ser-Ala-Lys-Glu-Leu-Arg-Xaa$_1$-Gln-Xaa$_2$-Ile-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:57) |
| a51) | RNH-Xaa$_3$-Ala-Lys-Glu-Leu-Arg-Xaa$_1$-Gln-Xaa$_2$-Ile-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:58) |
| a52) | RNH-Ser-Xaa$_3$-Lys-Glu-Leu-Arg-Xaa$_1$-Gln-Xaa$_2$-Ile-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:59) |
| a53) | RNH-Ser-Ala-Xaa$_3$-Glu-Leu-Arg-Xaa$_1$-Gln-Xaa$_2$-Ile-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:60) |
| a54) | RNH-Ser-Ala-Lys-Glu-Leu-Arg-Xaa$_1$-Gln-Xaa$_2$-Xaa$_4$-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:61) |
| a55) | RNH-Xaa$_3$-Ala-Lys-Glu-Leu-Arg-Xaa$_1$-Gln-Xaa$_2$-Xaa$_4$-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:62) |
| a56) | RNH-Ser-Xaa$_3$-Lys-Glu-Leu-Arg-Xaa$_1$-Gln-Xaa$_2$-Xaa$_4$-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:63) |
| a57) | RNH-Ser-Ala-Xaa$_3$-Glu-Leu-Arg-Xaa$_1$-Gln-Xaa$_2$-Xaa$_4$-Lys-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:64) |
| a58) | RNH-Ser-Ala-Lys-Glu-Leu-Arg-Xaa$_1$-Gln-Xaa$_2$-Ile-Xaa$_4$-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:65) |
| a59) | RNH-Xaa$_3$-Ala-Lys-Glu-Leu-Arg-Xaa$_1$-Gln-Xaa$_2$-Ile-Xaa$_4$-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:66) |
| a60) | RNH-Ser-Xaa$_3$-Lys-Glu-Leu-Arg-Xaa$_1$-Gln-Xaa$_2$-Ile-Xaa$_4$-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:67) |
| a61) | RNH-Ser-Ala-Xaa$_3$-Glu-Leu-Arg-Xaa$_1$-Gln-Xaa$_2$-Ile-Xaa$_4$-Thr-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:68) |
| a62) | RNH-Ser-Ala-Lys-Glu-Leu-Arg-Xaa$_1$-Gln-Xaa$_2$-Ile-Lys-Xaa$_4$-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:69) |
| a63) | RNH-Xaa$_3$-Ala-Lys-Glu-Leu-Arg-Xaa$_1$-Gln-Xaa$_2$-Ile-Lys-Xaa$_4$-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:70) |
| a64) | RNH-Ser-Xaa$_3$-Lys-Glu-Leu-Arg-Xaa$_1$-Gln-Xaa$_2$-Ile-Lys-Xaa$_4$-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:71) |
| a65) | RNH-Ser-Ala-Xaa$_3$-Glu-Leu-Arg-Xaa$_1$-Gln-Xaa$_2$-Ile-Lys-Xaa$_4$-Tyr-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:72) |
| a66) | RNH-Ser-Ala-Lys-Glu-Leu-Arg-Xaa$_1$-Gln-Xaa$_2$-Ile-Lys-Thr-Xaa$_4$-[linker]-Asn-Trp-<br>Val-Gln-Arg-Val-Val-Glu-Lys-Phe-Leu-Lys-Arg-Ala-Glu-Asn-(OH)NH$_2$ | (SEQ ID NO:73) |

-continued a67) RNH-Xaa₃-Ala-Lys-Glu-Leu-Arg-Xaa₁-Gln-Xaa₂-Ile-Lys-Thr-Xaa₄-[linker]-Asn-Trp-  (SEQ ID NO:74)
Val-Gln-Arg-Val-Val-Glu-Lys-Phe-Leu-Lys-Arg-Ala-Glu-Asn-(OH)NH₂ a68) RNH-Ser-Xaa₃-Lys-Glu-Leu-Arg-Xaa₁-Gln-Xaa₂-Ile-Lys-Thr-Xaa₄-[linker]-Asn-Trp-  (SEQ ID NO:75)
Val-Gln-Arg-Val-Val-Glu-Lys-Phe-Leu-Lys-Arg-Ala-Glu-Asn-(OH)NH₂ a69) RNH-Ser-Ala-Xaa₃-Glu-Leu-Arg-Xaa₁-Gln-Xaa₂-Ile-Lys-Thr-Xaa₄-[linker]-Asn-Trp-  (SEQ ID NO:76)
Val-Gln-Arg-Val-Val-Glu-Lys-Phe-Leu-Lys-Arg-Ala-Glu-Asn-(OH)NH₂

IL-8-1(1-11)-[linker]-IL-8-(56-71)-acid or amide
a70) RNH-Ser-Ala-Lys-Glu-Leu-Arg-Cys-Gln-Cys-Ile-Lys-[liner]-Asn-Trp-Val-Gln-Arg-  (SEQ ID NO:77)
Val-Val-Glu-Lys-Phe-Leu-Lys-Arg-Ala-Glu-Asn-(OH)NH₂ a71) RNH-Ser-Ala-Lys-Glu-Leu-Arg-Xaa₁-Gln-Xaa₂-Ile-Lys-[linker]-Asn-Trp-Val-Gln-  (SEQ ID NO:78)
Arg-Val-Val-Glu-Lys-Phe-Leu-Lys-Arg-Ala-Glu-Asn-(OH)NH₂ a72) RNH-Xaa₃-Ala-Lys-Glu-Leu-Arg-Xaa₁-Gln-Xaa₂-Ile-Lys-[linker]-Asn-Trp-Val-Gln-  (SEQ ID NO:79)
Arg-Val-Val-Glu-Lys-Phe-Leu-Lys-Arg-Ala-Glu-Asn-(OH)NH₂ a73) RNH-Ser-Xaa₃-Lys-Glu-Leu-Arg-Xaa₁-Gln-Xaa₂-Ile-Lys-[linker]-Asn-Trp-Val-Gln-  (SEQ ID NO:80)
Arg-Val-Val-Glu-Lys-Phe-Leu-Lys-Arg-Ala-Glu-Asn-(OH)NH₂ a74) RNH-Ser-Ala-Xaa₃-Glu-Leu-Arg-Xaa₁-Gln-Xaa₂-Ile-Lys-[linker]-Asn-Trp-Val-Gln-  (SEQ ID NO:81)
Arg-Val-Val-Glu-Lys-Phe-Leu-Lys-Arg-Ala-Glu-Asn-(OH)NH₂ a75) RNH-Ser-Ala-Lys-Glu-Leu-Arg-Xaa₁-Gln-Xaa₂-Xaa₄-Lys-[linker]-Asn-Trp-Val-Gln-  (SEQ ID NO:82)
Arg-Val-Val-Glu-Lys-Phe-Leu-Lys-Arg-Ala-Glu-Asn-(OH)NH₂ a76) RNH-Xaa₃-Ala-Lys-Glu-Leu-Arg-Xaa₁-Gln-Xaa₂-Xaa₄-Lys-linker]-Asn-Trp-Val-Gln-  (SEQ ID NO:83)
Arg-Val-Val-Glu-Lys-Phe-Leu-Lys-Arg-Ala-Glu-Asn-(OH)NH₂ a77) RNH-Ser-Xaa₃-Lys-Glu-Leu-Arg-Xaa₁-Gln-Xaa₂-Xaa₄-Lys-linker]-Asn-Trp-Val-Gln-  (SEQ ID NO:84)
Arg-Val-Val-Glu-Lys-Phe-Leu-Lys-Arg-Ala-Glu-Asn-(OH)NH₂ a78) RNH-Ser-Ala-Xaa₃-Glu-Leu-Arg-Xaa₁-Gln-Xaa₂-Xaa₄-Lys-linker]-Asn-Trp-Val-Gln-  (SEQ ID NO:85)
Arg-Val-Val-Glu-Lys-Phe-Leu-Lys-Arg-Ala-Glu-Asn-(OH)NH₂ a79) RNH-Ser-Ala-Lys-Glu-Leu-Arg-Xaa₁-Gln-Xaa₂-Ile-Xaa₄-[linker]-Asn-Trp-Val-Gln-  (SEQ ID NO:86)
Arg-Val-Val-Glu-Lys-Phe-Leu-Lys-Arg-Ala-Glu-Asn-(OH)NH₂ a80) RNH-Xaa₃-Ala-Lys-Glu-Leu-Arg-Xaa₁-Gln-Xaa₂-Ile-Xaa₄-[linker]-Asn-Trp-Val-Gln-  (SEQ ID NO:87)
Arg-Val-Val-Glu-Lys-Phe-Leu-Lys-Arg-Ala-Glu-Asn-(OH)NH₂ a81) RNH-Ser-Xaa₃-Lys-Glu-Leu-Arg-Xaa₁-Gln-Xaa₂-Ile-Xaa₄-[linker]-Asn-Trp-Val-Gln-  (SEQ ID NO:88)
Arg-Val-Val-Glu-Lys-Phe-Leu-Lys-Arg-Ala-Glu-Asn-(OH)NH₂ a82) RNH-Ser-Ala-Xaa₃-Glu-Leu-Arg-Xaa₁-Gln-Xaa₂-Ile-Xaa₄-[linker]-Asn-Trp-Val-Gln-  (SEQ ID NO:89)
Arg-Val-Val-Glu-Lys-Phe-Leu-Lys-Arg-Ala-Glu-Asn-(OH)NH₂

Preferred embodiments of cyclic IL-8 analogs of the present invention corresponding to a cyclic portion of the N-terminal-region of IL-8 having the following structures:

[Xaa₅¹, Xaa₆¹³]-IL-8-1(1-13) cyclic (Xaa₅-Xaa₆) acid or amide
a83) RNH-Xaa₅-Ala-Lys-Glu-Leu-Arg-Xaa₁-Gln-Xaa₂-Ile-Lys-Thr-Xaa₆-(OH)NH₂   (SEQ ID NO:90)

a84) RNH-Xaa₅-Xaa₃-Lys-Glu-Leu-Arg-Xaa₁-Gln-Xaa₂-Ile-Lys-Thr-Xaa₆-(OH)NH₂   (SEQ ID NO:91)

a85) RNH-Xaa₅-Ala-Xaa₃-Glu-Leu-Arg-Xaa₁-Gln-Xaa₂-Ile-Lys-Thr-Xaa₆-(OH)NH₂   (SEQ ID NO:92)

Preferred embodiments of cyclic IL-8 analogs of the present invention corresponding to a cyclic portion of the internal-region of IL-8 having the following structures (the underlined residues below are cyclized):

Preferred embodiments of cyclic IL-8 analogs of the present invention corresponding to a cyclic portion of the C-terminal region of IL-8 having the following structures (the underlined residues below are cyclized):

[Xaa₅⁹, Xaa₆³⁴]-IL-8-1(9-34) cyclic (Xaa₅–Xaa₆) acid or amide
a86) RNH-Xaa₅-Ile-Lys-Thr-Tyr-Ser-Lys-Pro-Phe-His-Pro-Lys-Phe-Ile-Lys-Glu-Leu-  (SEQ ID NO:93)
Arg-Val-Ile-Glu-Ser-Gly-Pro-His-Xaa₆-(OH)NH₂

[Xaa₅³⁴, Xaa₆⁵⁰]-IL-8-1(34-50) cyclic (Xaa₅–Xaa₆) acid or amide)
a87) RNH-Xaa₅-Ala-Asn-Thr-Glu-Ile-Ile-Val-Lys-Leu-Ser-Asp-Gly-Arg-Glu-Leu-Xaa₆-  (SEQ ID NO:94)
(OH)NH₂

[Xaa$_5^{50}$, Xaa$_6^{72}$]-IL-8-1(50–72) cyclic (Xaa$_5$–Xaa$_6$) acid or amide
a88)  RNH-Xaa$_5$-Leu-Asp-Pro-Lys-Glu-Asn-Trp-Val-Gln-Arg-Val-Val-Glu-Lys-Phe-Leu-  (SEQ ID NO:95)
      Lys-Arg-Ala-Glu-Asn-Xaa$_6$-(OH)NH$_2$

[A$^{50}$]-IL-8-1(50–72) cyclic (Glu63–Lys67) acid or amide
a89)  RNH-Ala-Leu-Asp-Pro-Lys-Glu-Asn-Trp-Val-Gln-Arg-Val-Val-Glu-Lys-Phe-Leu-Lys-  (SEQ ID NO:96)
      Arg-Ala-Glu-Asn-Ser-(OH)NH$_2$

[A$^{50}$]- IL-8-1(50–72) cyclic (Lys67–Glu70) acid or amide
a90)  RNH-Ala-Leu-Asp-Pro-Lys-Glu-Asn-Trp-Val-Gln-Arg-Val-Val-Glu-Lys-Phe-Leu-Lys-  (SEQ ID NO:97)
      Arg-Ala-Glu-Asn-Ser-(OH)NH$_2$

[A$^{50}$]-IL-8-1(50–72) cyclic (Lys64–Glu70) acid or amide
a91)  RNH-Ala-Leu-Asp-Pro-Lys-Glu-Asn-Trp-Val-Gln-Arg-Val-Val-Glu-Lys-Phe-Leu-Lys-  (SEQ ID NO:99)
      Arg-Ala-Glu-Asn-Ser-(OH)NH$_2$ Preferred embodiments of cyclic IL-8 analogs of the present invention corresponding to a portion the N-terminal region joined with a linker to a cyclic portion of the C-terminal region of IL-8 having the following structures (the underlined residues below are cyclized):

IL-8-1(1–15)-[linker]-IL-8-(56–71)-cyclic (Glu63–Lys67) acid or amide
a92)  RNH-Ser-Ala-Lys-Glu-Leu-Arg-Cys-Gln-Cys-Ile-Lys-Thr-Tyr-Ser-Lys-[linker]-Asn-  (SEQ ID NO:100)
      Trp-Val-Gln-Arg-Val-Val-Glu-Lys-Phe-Leu-Lys-Arg-Ala-Glu-Asn-(OH)NH$_2$ a93)  RNH-Ser-Ala-Lys-Glu-Leu-Arg-Xaa-Gln-Xaa$_2$-Ile-Lys-Thr-Tyr-Ser-Lys-[linker]-Asn-  (SEQ ID NO:101)
      Trp-Val-Gln-Arg-Val-Val-Glu-Lys-Phe-Leu-Lys-Arg-Ala-Glu-Asn-(OH)NH$_2$ a94)  RNH-Xaa$_3$-Ala-Lys-Glu-Leu-Arg-Xaa$_1$-Gln-Xaa$_2$-Ile-Lys-Thr-Tyr-Ser-Lys-[linker]-  (SEQ ID NO:102)
      Asn-Trp-Val-Gln-Arg-Val-Val-Glu-Lys-Phe-Leu-Lys-Arg-Ala-Glu-Asn-(OH)NH$_2$ a95)  RNH-Ser-Xaa$_3$-Lys-Glu-Leu-Arg-Xaa$_1$-Gln-Xaa$_2$-Ile-Lys-Thr-Tyr-Ser-Lys-[linker]-  (SEQ ID NO:103)
      Asn-Trp-Val-Gln-Arg-Val-Val-Glu-Lys-Phe-Leu-Lys-Arg-Ala-Glu-Asn-(OH)NH$_2$ a96)  RNH-Ser-Ala-Xaa$_3$-Glu-Leu-Arg-Xaa$_1$-Gln-Xaa$_2$-Ile-Lys-Thr-Tyr-Ser-Lys-[linker]-  (SEQ ID NO:104)
      Asn-Trp-Val-Gln-Arg-Val-Val-Glu-Lys-Phe-Leu-Lys-Arg-Ala-Glu-Asn-(OH)NH$_2$ a97)  RNH-Ser-Ala-Lys-Glu-Leu-Arg-Xaa$_1$-Gln-Xaa$_2$-Xaa$_4$-Lys-Thr-Tyr-Ser-Lys-[linker]-  (SEQ ID NO:105)
      Asn-Trp-Val-Gln-Arg-Val-Val-Glu-Lys-Phe-Leu-Lys-Arg-Ala-Glu-Asn-(OH)NH$_2$ a98)  RNH-Xaa$_3$-Ala-Lys-Glu-Leu-Arg-Xaa$_1$-Gln-Xaa$_2$-Xaa$_4$-Lys-Thr-Tyr-Ser-Lys-[linker]-  (SEQ ID NO:106)
      Asn-Trp-Val-Gln-Arg-Val-Val-Glu-Lys-Phe-Leu-Lys-Arg-Ala-Glu-Asn-(OH)NH$_2$ a99)  RNH-Ser-Xaa$_3$-Lys-Glu-Leu-Arg-Xaa$_1$-Gln-Xaa$_2$-Xaa$_4$-Lys-Thr-Tyr-Ser-Lys-[linker]-  (SEQ ID NO:107)
      Asn-Trp-Val-Gln-Arg-Val-Val-Glu-Lys-Phe-Leu-Lys-Arg-Ala-Glu-Asn-(OH)NH$_2$ a100) RNH-Ser-Ala-Xaa$_3$-Glu-Leu-Arg-Xaa$_1$-Gln-Xaa$_2$-Xaa$_4$-Lys-Thr-Tyr-Ser-Lys-[linker]-  (SEQ ID NO:108)
      Asn-Trp-Val-Gln-Arg-Val-Val-Glu-Lys-Phe-Leu-Lys-Arg-Ala-Glu-Asn-(OH)NH$_2$ a101) RNH-Ser-Ala-Lys-Glu-Leu-Arg-Xaa$_1$-Gln-Xaa$_2$-Ile-Xaa$_4$-Thr-Tyr-Ser-Lys-[linker]-  (SEQ ID NO:109)
      Asn-Trp-Val-Gln-Arg-Val-Val-Glu-Lys-Phe-Leu-Lys-Arg-Ala-Glu-Asn-(OH)NH$_2$ a102) RNH-Xaa$_3$-Ala-Lys-Glu-Leu-Arg-Xaa$_1$-Gln-Xaa$_2$-Ile-Xaa$_1$-Thr-Tyr-Ser-Lys-[linker]-  (SEQ ID NO:110)
      Asn-Trp-Val-Gln-Arg-Val-Val-Glu-Lys-Phe-Leu-Lys-Arg-Ala-Glu-Asn-(OH)NH$_2$ a103) RNH-Ser-Xaa$_3$-Lys-Glu-Leu-Arg-Xaa$_1$-Gln-Xaa$_2$-Ile-Xaa$_4$-Thr-Tyr-Ser-Lys-[linker]-  (SEQ ID NO:111)
      Asn-Trp-Val-Gln-Arg-Val-Val-Glu-Lys-Phe-Leu-Lys-Arg-Ala-Glu-Asn-(OH)NH$_2$ a104) RNH-Ser-Ala-Xaa$_3$-Glu-Leu-Arg-Xaa$_1$-Gln-Xaa$_2$-Ile-Xaa$_4$-Thr-Tyr-Ser-Lys-[linker]-  (SEQ ID NO:112)
      Asn-Trp-Val-Gln-Arg-Val-Val-Glu-Lys-Phe-Leu-Lys-Arg-Ala-Glu-Asn-(OH)NH$_2$ a105) RNH-Ser-Ala-Lys-Glu-Leu-Arg-Xaa$_1$-Gln-Xaa$_2$-Ile-Lys-Xaa$_4$-Tyr-Ser-Lys-[linker]-  (SEQ ID NO:113)
      Asn-Trp-Val-Gln-Arg-Val-Val-Glu-Lys-Phe-Leu-Lys-Arg-Ala-Glu-Asn-(OH)NH$_2$ a106) RNH-Xaa$_3$-Ala-Lys-Glu-Leu-Arg-Xaa$_1$-Gln-Xaa$_2$-Ile-Lys-Xaa$_4$-Tyr-Ser-Lys-[linker]-  (SEQ ID NO:114)
      Asn-Trp-Val-Gln-Arg-Val-Val-Glu-Lys-Phe-Leu-Lys-Arg-Ala-Glu-Asn-(OH)NH$_2$ a107) RNH-Ser-Xaa$_3$-Lys-Glu-Leu-Arg-Xaa$_1$-Gln-Xaa$_2$-Ile-Lys-Xaa$_1$-Tyr-Ser-Lys-[linker]-  (SEQ ID NO:115)
      Asn-Trp-Val-Gln-Arg-Val-Val-Glu-Lys-Phe-Leu-Lys-Arg-Ala-Glu-Asn-(OH)NH$_2$ a108) RNH-Ser-Ala-Xaa$_3$-Glu-Leu-Arg-Xaa$_1$-Gln-Xaa$_2$-Ile-Lys-Xaa$_4$-Tyr-Ser-Lys-[linker]-  (SEQ ID NO:116)
      Asn-Trp-Val-Gln-Arg-Val-Val-Glu-Lys-Phe-Leu-Lys-Arg-Ala-Glu-Asn-(OH)NH$_2$ -continued a109) RNH-Ser-Ala-Lys-Glu-Leu-Arg-Xaa$_1$-Gln-Xaa$_2$-Ile-Lys-Thr-Xaa$_4$-Ser-Lys-[linker]- (SEQ ID NO:117)
Asn-Trp-Val-Gln-Arg-Val-Val-<u>Glu</u>-Lys-Phe-Leu-<u>Lys</u>-Arg-Ala-Glu-Asn-(OH)NH$_2$ a110) RNH-Xaa$_3$-Ala-Lys-Glu-Leu-Arg-Xaa$_1$-Gln-Xaa$_2$-Ile-Lys-Thr-Xaa$_4$-Ser-Lys-[linker]- (SEQ ID NO:118)
Asn-Trp-Val-Gln-Arg-Val-Val-<u>Glu</u>-Lys-Phe-Leu-<u>Lys</u>-Arg-Ala-Glu-Asn-(OH)NH$_2$ a111) RNH-Ser-Xaa$_3$-Lys-Glu-Leu-Arg-Xaa$_1$-Gln-Xaa$_2$-Ile-Lys-Thr-Xaa$_4$-Ser-Lys-[linker]- (SEQ ID NO:119)
Asn-Trp-Val-Gln-Arg-Val-Val-<u>Glu</u>-Lys-Phe-Leu-<u>Lys</u>-Arg-Ala-Glu-Asn-(OH)NH$_2$ a112) RNH-Ser-Ala-Xaa$_3$-Glu-Leu-Arg-Xaa$_1$-Gln-Xaa$_2$-Ile-Lys-Thr-Xaa$_4$-Ser-Lys-[linker]- (SEQ ID NO:120)
Asn-Trp-Val-Gln-Arg-Val-Val-<u>Glu</u>-Lys-Phe-Leu-<u>Lys</u>-Arg-Ala-Glu-Asn-(OH)NH$_2$ a113) RNH-Ser-Ala-Lys-Glu-Leu-Arg-Xaa$_1$-Gln-Xaa$_2$-Ile-Lys-Thr-Tyr-Xaa$_4$-Lys-[linker]- (SEQ ID NO:121)
Asn-Trp-Val-Gln-Arg-Val-Val-<u>Glu</u>-Lys-Phe-Leu-<u>Lys</u>-Arg-Ala-Glu-Asn-(OH)NH$_2$ a114) RNH-Xaa$_3$-Ala-Lys-Glu-Leu-Arg-Xaa$_1$-Gln-Xaa$_2$-Ile-Lys-Thr-Tyr-Xaa$_4$-Lys-[linker]- (SEQ ID NO:122)
Asn-Trp-Val-Gln-Arg-Val-Val-<u>Glu</u>-Lys-Phe-Leu-<u>Lys</u>-Arg-Ala-Glu-Asn-(OH)NH$_2$ a115) RNH-Ser-Xaa$_3$-Lys-Glu-Leu-Arg-Xaa$_1$-Gln-Xaa$_2$-Ile-Lys-Thr-Tyr-Xaa$_4$-Lys-[linker]- (SEQ ID NO:123)
Asn-Trp-Val-Gln-Arg-Val-Val-<u>Glu</u>-Lys-Phe-Leu-<u>Lys</u>-Arg-Ala-Glu-Asn-(OH)NH$_2$ a116) RNH-Ser-Ala-Xaa$_3$-Glu-Leu-Arg-Xaa$_1$-Gln-Xaa$_2$-Ile-Lys-Thr-Tyr-Xaa$_4$-Lys-[linker]- (SEQ ID NO:124)
Asn-Trp-Val-Gln-Arg-Val-Val-<u>Glu</u>-Lys-Phe-Leu-<u>Lys</u>-Arg-Ala-Glu-Asn-(OH)NH$_2$ a117) RNH-Ser-Ala-Lys-Glu-Leu-Arg-Xaa$_1$-Gln-Xaa$_2$-Ile-Lys-Thr-Tyr-Ser-Xaa$_4$-[linker]- (SEQ ID NO:125)
Asn-Trp-Val-Gln-Arg-Val-Val-<u>Glu</u>-Lys-Phe-Leu-<u>Lys</u>-Arg-Ala-Glu-Asn-(OH)NH$_2$ a118) RNH-Xaa$_3$-Ala-Lys-Glu-Leu-Arg-Xaa$_1$-Gln-Xaa$_2$-Ile-Lys-Thr-Tyr-Ser-Xaa$_4$-[linker]- (SEQ ID NO:126)
Asn-Trp-Val-Gln-Arg-Val-Val-<u>Glu</u>-Lys-Phe-Leu-<u>Lys</u>-Arg-Ala-Glu-Asn-(OH)NH$_2$ a119) RNH-Ser-Xaa$_3$-Lys-Glu-Leu-Arg-Xaa$_1$-Gln-Xaa$_2$-Ile-Lys-Thr-Tyr-Ser-Xaa$_4$-[linker]- (SEQ ID NO:127)
Asn-Trp-Val-Gln-Arg-Val-Val-<u>Glu</u>-Lys-Phe-Leu-<u>Lys</u>-Arg-Ala-Glu-Asn-(OH)NH$_2$ a120) RNH-Ser-Ala-Xaa$_3$-Glu-Leu-Arg-Xaa$_1$-Gln-Xaa$_2$-Ile-Lys-Thr-Tyr-Ser-Xaa$_4$-[linker]- (SEQ ID NO:128)
Asn-Trp-Val-Gln-Arg-Val-Val-<u>Glu</u>-Lys-Phe-Leu-<u>Lys</u>-Arg-Ala-Glu-Asn-(OH)NH$_2$ IL-8-1(1-13)-[linker]-IL-8-(56-71)-cyclic(Glu63-Lys67) acid or amide a121) RNH-Ser-Ala-Lys-Glu-Leu-Arg-Cys-Gln-Cys-Ile-Lys-Thr-Tyr-[linker]-Asn-Trp-Val- (SEQ ID NO:129)
Gln-Arg-Val-Val-<u>Glu</u>-Lys-Phe-Leu-<u>Lys</u>-Arg-Ala-Glu-Asn-(OH)NH$_2$ a122) RNH-Ser-Ala-Lys-Glu-Leu-Arg-Xaa$_1$-Gln-Xaa$_2$-Ile-Lys-Thr-Tyr-[linker]-Asn-Trp- (SEQ ID NO:130)
Val-Gln-Arg-Val-Val-<u>Glu</u>-Lys-Phe-Leu-<u>Lys</u>-Arg-Ala-Glu-Asn-(OH)NH$_2$ a123) RNH-Xaa$_3$-Ala-Lys-Glu-Leu-Arg-Xaa$_1$-Gln-Xaa$_2$-Ile-Lys-Thr-Tyr-[linker]-Asn-Trp- (SEQ ID NO:131)
Val-Gln-Arg-Val-Val-<u>Glu</u>-Lys-Phe-Leu-<u>Lys</u>-Arg-Ala-Glu-Asn-(OH)NH$_2$ a124) RNH-Ser-Xaa$_3$-Lys-Glu-Leu-Arg-Xaa$_1$-Gln-Xaa$_2$-Ile-Lys-Thr-Tyr-[linker]-Asn-Trp- (SEQ ID NO:132)
Val-Gln-Arg-Val-Val-<u>Glu</u>-Lys-Phe-Leu-<u>Lys</u>-Arg-Ala-Glu-Asn-(OH)NH$_2$ a125) RNH-Ser-Ala-Xaa$_3$-Glu-Leu-Arg-Xaa$_1$-Gln-Xaa$_2$-Ile-Lys-Thr-Tyr-[linker]-Asn-Trp- (SEQ ID NO:133)
Val-Gln-Arg-Val-Val-<u>Glu</u>-Lys-Phe-Leu-<u>Lys</u>-Arg-Ala-Glu-Asn-(OH)NH$_2$ a126) RNH-Ser-Ala-Lys-Glu-Leu-Arg-Xaa$_1$-Gln-Xaa$_2$-Xaa$_4$-Lys-Thr-Tyr-[linker]-Asn-Trp- (SEQ ID NO:134)
Val-Gln-Arg-Val-Val-<u>Glu</u>-Lys-Phe-Leu-<u>Lys</u>-Arg-Ala-Glu-Asn-(OH)NH$_2$ a127) RNH-Xaa$_3$-Ala-Lys-Glu-Leu-Arg-Xaa$_1$-Gln-Xaa$_2$-Xaa$_4$-Lys-Thr-Tyr-[linker]-Asn-Trp- (SEQ ID NO:135)
Val-Gln-Arg-Val-Val-<u>Glu</u>-Lys-Phe-Leu-<u>Lys</u>-Arg-Ala-Glu-Asn-(OH)NH$_2$ a128) RNH-Ser-Xaa$_3$-Lys-Glu-Leu-Arg-Xaa$_1$-Gln-Xaa$_2$-Xaa$_4$-Lys-Thr-Tyr-[linker]-Asn-Trp- (SEQ ID NO:136)
Val-Gln-Arg-Val-Val-<u>Glu</u>-Lys-Phe-Leu-<u>Lys</u>-Arg-Ala-Glu-Asn-(OH)NH$_2$ a129) RNH-Ser-Ala-Xaa$_3$-Glu-Leu-Arg-Xaa$_1$-Gln-Xaa$_2$-Xaa$_4$-Lys-Thr-Tyr-[linker]-Asn-Trp- (SEQ ID NO:137)
Val-Gln-Arg-Val-Val-<u>Glu</u>-Lys-Phe-Leu-<u>Lys</u>-Arg-Ala-Glu-Asn-(OH)NH$_2$ a130) RNH-Ser-Ala-Lys-Glu-Leu-Arg-Xaa$_1$-Gln-Xaa$_2$-Ile-Xaa$_4$-Thr-Tyr-[linker]-Asn-Trp- (SEQ ID NO:138)
Val-Gln-Arg-Val-Val-<u>Glu</u>-Lys-Phe-Leu-<u>Lys</u>-Arg-Ala-Glu-Asn-(OH)NH$_2$ a131) RNH-Xaa$_3$-Ala-Lys-Glu-Leu-Arg-Xaa$_1$-Gln-Xaa$_2$-Ile-Xaa$_4$-Thr-Tyr-[linker]-Asn-Trp- (SEQ ID NO:139)
Val-Gln-Arg-Val-Val-<u>Glu</u>-Lys-Phe-Leu-<u>Lys</u>-Arg-Ala-Glu-Asn-(OH)NH$_2$ a132) RNH-Ser-Xaa$_3$-Lys-Glu-Lu-Arg-Xaa$_1$-Gln-Xaa$_2$-Ile-Xaa$_4$-Thr-Tyr-[linker]-Asn-Trp- (SEQ ID NO:140)
Val-Gln-Arg-Val-Val-<u>Glu</u>-Lys-Phe-Leu-<u>Lys</u>-Arg-Ala-Glu-Asn-(OH)NH$_2$ a133) RNH-Ser-Ala-Xaa$_3$-Glu-Leu-Arg-Xaa$_1$-Gln-Xaa$_2$-Ile-Xaa$_4$-Thr-Tyr-[linker]-Asn-Trp- (SEQ ID NO:141)
Val-Gln-Arg-Val-Val-<u>Glu</u>-Lys-Phe-Leu-<u>Lys</u>-Arg-Ala-Glu-Asn-(OH)NH$_2$ a134) RNH-Ser-Ala-Lys-Glu-Leu-Arg-Xaa$_1$-Gln-Xaa$_2$-Ile-Lys-Xaa$_4$-Tyr-[linker]-Asn-Trp- (SEQ ID NO:142)
Val-Gln-Arg-Val-Val-<u>Glu</u>-Lys-Phe-Leu-<u>Lys</u>-Arg-Ala-Glu-Asn-(OH)NH$_2$ -continued a135) RNH-Xaa₃-Ala-Lys-Glu-Leu-Arg-Xaa₁-Gln-Xaa₂-Ile-Lys-Xaa₄-Tyr-[linker]-Asn-Trp-  (SEQ ID NO:143)
     Val-Gln-Arg-Val-Val-<u>Glu</u>-Lys-Phe-Leu-<u>Lys</u>-Arg-Ala-Glu-Asn-(OH)NH₂ a136) RNH-Ser-Xaa₃-Lys-Glu-Leu-Arg-Xaa₁-Gln-Xaa₂-Ile-Lys-Xaa₅-Tyr-[linker]-Asn-Trp-  (SEQ ID NO:144)
     Val-Gln-Arg-Val-Val-<u>Glu</u>-Lys-Phe-Leu-<u>Lys</u>-Arg-Ala-Glu-Asn-(OH)NH₂ a137) RNH-Ser-Ala-Xaa₃-Glu-Leu-Arg-Xaa₁-Gln-Xaa₂-Ile-Lys-Xaa₄-Tyr-[linker]-Asn-Trp-  (SEQ ID NO:145)
     Val-Gln-Arg-Val-Val-<u>Glu</u>-Lys-Phe-Leu-<u>Lys</u>-Arg-Ala-Glu-Asn-(OH)NH₂ a138) RNH-Ser-Ala-Lys-Glu-Leu-Arg-Xaa₁-Gln-Xaa₂--Ile-Lys-Thr-Xaa₄-[linker]-Asn-Trp-  (SEQ ID NO:146)
     Val-Gln-Arg-Val-Val-<u>Glu</u>-Lys-Phe-Leu-<u>Lys</u>-Arg-Ala-Glu-Asn-(OH)NH₂ a139) RNH-Xaa₃-Ala-Lys-Glu-Leu-Arg-Xaa₁-Gln-Xaa₂--Ile-Lys-Thr-Xaa₄₋₁ ₋[linker]-Asn-Trp  (SEQ ID NO:147)
     Val-Gln-Arg-Val-Val-<u>Glu</u>-Lys-Phe-Leu-<u>Lys</u>-Arg-Ala-Glu-Asn-(OH)NH₂ a140) RNH-Ser-Xaa₃-Lys-Glu-Leu-Arg-Xaa₁-Gln-Xaa₂-Ile-Lys-Thr-Xaa₄₋₁ ₋[linker]-Asn-Trp  (SEQ ID NO:148)
     Val-Gln-Arg-Val-Val-<u>Glu</u>-Lys-Phe-Leu-<u>Lys</u>-Arg-Ala-Glu-Asn-(OH)NH₂ a141) RNH-Ser-Ala-Xaa₃-Glu-Leu-Arg-Xaa₁-Gln-Xaa₂-Ile-Lys-Thr-Xaa₄-[linker]-Asn-Trp-  (SEQ ID NO:149)
     Val-Gln-Arg-Val-Val-<u>Glu</u>-Lys-Phe-Leu-<u>Lys</u>-Arg-Ala-Glu-Asn-(OH)NH₂

IL-8-1(1-11)-[linker]-IL-8-(56-71) cyclic(Glu63-Lys67) acid or amide
a142) RNH-Ser-Ala-Lys-Glu-Leu-Arg-Cys-Gln-Cys-Ile-Lys-linker]-Asn-Trp-Val-Gln-Arg-  (SEQ ID NO:150)
     Val-Val-<u>Glu</u>-Lys-Phe-Leu-<u>Lys</u>-Arg-Ala-Glu-Asn-(OH)NH₂ a143) RNH-Ser-Ala-Lys-Glu-Leu-Arg-Xaa₁-Gln-Xaa₂-Ile-Lys-[linker]-Asn-Trp-Val-Gln-  (SEQ ID NO:151)
     Arg-Val-Val-<u>Glu</u>-Lys-Phe-Leu-<u>Lys</u>-Arg-Ala-Glu-Asn-(OH)NH₂ a144) RNH-Xaa₃-Ala-Lys-Glu-Leu-Arg-Xaa₁-Gln-Xaa₂-Ile-Lys-[linker]-Asn-Trp-Val-Gln-  (SEQ ID NO:152)
     Arg-Val-Val-<u>Glu</u>-Lys-Phe-Leu-<u>Lys</u>-Arg-Ala-Glu-Asn-(OH)NH₂ a145) RNH-Ser-Xaa₃-Lys-Glu-Leu-Arg-Xaa₁-Gln-Xaa₂-Ile-Lys-[linker]-Asn-Trp-Val-Gln-  (SEQ ID NO:153)
     Arg-Val-Val-<u>Glu</u>-Lys-Phe-Leu-<u>Lys</u>-Arg-Ala-Glu-Asn-(OH)NH₂ a146) RNH-Ser-Ala-Xaa₃-Glu-Leu-Arg-Xaa₁-Gln-Xaa₂-Ile-Lys-[linker]-Asn-Trp-Val-Gln-  (SEQ ID NO:154)
     Arg-Val-Val-<u>Glu</u>-Lys-Phe-Leu-<u>Lys</u>-Arg-Ala-Glu-Asn-(OH)NH₂ a147) RNH-Ser-Ala-Lys-Glu-Leu-Arg-Xaa₁-Gln-Xaa₂-Xaa₄-Lys-[linker]-Asn-Trp-Val-Gln-  (SEQ ID NO:155)
     Arg-Val-Val-<u>Glu</u>-Lys-Phe-Leu-<u>Lys</u>-Arg-Ala-Glu-Asn-(OH)NH₂ a148) RNH-Xaa₃-Ala-Lys-Glu-Leu-Arg-Xaa₁-Gln-Xaa₂-Xaa₄-Lys-[linker]-Asn-Trp-Val-Gln-  (SEQ ID NO:156)
     Arg-Val-Val-<u>Glu</u>-Lys-Phe-Leu-<u>Lys</u>-Arg-Ala-Glu-Asn-(OH)NH₂ a149) RNH-Ser-Xaa₃-Lys-Glu-Leu-Arg-Xaa₁-Gln-Xaa₂-Xaa₄-Lys-[linker]-Asn-Trp-Val-Gln-  (SEQ ID NO:157)
     Arg-Val-Val-<u>Glu</u>-Lys-Phe-Leu-<u>Lys</u>-Arg-Ala-Glu-Asn-(OH)NH₂ a150) RNH-Ser-Ala-Xaa₃-Glu-Leu-Arg-Xaa₁-Gln-Xaa₂-Xaa₁-Lys-[linker]-Asn-Trp-Val-Gln-  (SEQ ID NO:158)
     Arg-Val-Val-<u>Glu</u>-Lys-Phe-Leu-<u>Lys</u>-Arg-Ala-Glu-Asn-(OH)NH₂ a151) RNH-Ser-Ala-Lys-Glu-Leu-Arg-Xaa₁-Gln-Xaa₂-Ile-Xaa₄-[linker]-Asn-Trp-Val-Gln-  (SEQ ID NO:159)
     Arg-Val-Val-<u>Glu</u>-Lys-Phe-Leu-<u>Lys</u>-Arg-Ala-Glu-Asn-(OH)NH₂ a152) RNH-Xaa₃-Ala-Lys-Glu-Leu-Arg-Xaa₁-Gln-Xaa₂-Ile-Xaa₄-[linker]-Asn-Trp-Val-Gln-  (SEQ ID NO:160)
     Arg-Val-Val-<u>Glu</u>-Lys-Phe-Leu-<u>Lys</u>-Arg-Ala-Glu-Asn-(OH)NH₂ a153) RNH-Ser-Xaa₃-Lys-Glu-Leu-Arg-Xaa₁-Gln-Xaa₂-Ile-Xaa₄-[linker]-Asn-Trp-Val-Gln-  (SEQ ID NO:161)
     Arg-Val-Val-<u>Glu</u>-Lys-Phe-Leu-<u>Lys</u>-Arg-Ala-Glu-Asn-(OH)NH₂ a154) RNH-Ser-Ala-Xaa₃-Glu-Leu-Arg-Xaa₁-Gln-Xaa₂-Ile-Xaa₄-[linker]-Asn-Trp-Val-Gln-  (SEQ ID NO:162)
     Arg-Val-Val-<u>Glu</u>-Lys-Phe-Leu-<u>Lys</u>-Arg-Ala-Glu-Asn-(OH)NH₂

In the above structures:

R is selected from the group consisting of hydrogen, alkyl, alkenyl, alkynyl, alkylcarbonyl, arylcarbonyl, aryl, PEG (polyethyleneglycol) and any other modifying group.

Xaa₃ is selected from the group consisting of L-Pro, D-Pro, P*, Btd and any L- or D-natural and non-natural amino acid.

Xaa₄ is selected from the group consisting of P*, Btd and any L- or D-natural amino acid and any non-natural amino acid.

Xaa₅ is selected from the group consisting of any L- or D-natural amino acid and any non-natural amino acid with functional side chain to allow cyclization with Xaa₆.

Xaa₆ is selected from the group consisting of any L- or D-natural amino acid and any non-natural amino acid with functional side chain to allow cyclization with Xaa₅.

P* is:

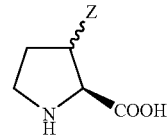

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, Orn to Asp. Moieties other than naturally occurring amino acids may also be substituted, such as Btd:

Btd* is:

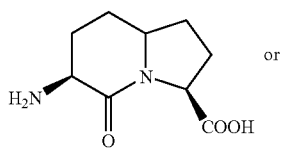

or

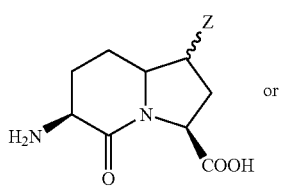

or

-continued

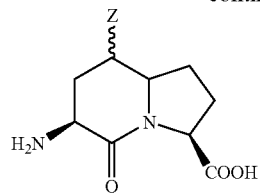

Z=hydrogen, alkyl, alkenyl, alkylcarbonyl, arylcarbonyl, aryl, aryl-hydroxy, and more $Xaa_1$ is selected from the group consisting of any L- or D-natural amino acid and any non-natural amino acid.

$Xaa_2$ is selected from the group consisting of any L- or D-natural amino acid and any non-natural amino acid.

The linker is a bifunctional group covalently attached to the N-terminal and C-terminal portions of the analog having the structure: $H_2N$-$Z_A$-COOH wherein $Z_A$ is selected from the group consisting of: (1) alkyl, alkenyl, aralkyl, alkynyl; (2) —$(CH_2)_n$— wherein n is an integer n=9 to 14; (3) any combination of four natural amino acids or non-natural amino acids; and (4) -$(Gly)_4$- (SEQ ID NO: 1640).

IP-10 Compounds:

Preferred embodiments of linear IP-10 analogs of the present invention corresponding to a portion of N-terminal have the following structures:

```
IP-10-(1-14) acid or amide
b1)   RNH-Val-Pro-Leu-Ser-Arg-Thr-Val-Arg-Cys-Thr-Cys-Ile-Ser-Ile-(OH)NH₂       (SEQ ID NO:163)

b2)   RNH-Val-Pro-Xaa₃-Ser-Arg-Thr-Val-Arg-Xaa₁-Thr-Xaa₂-Ile-Ser-Ile-(OH)NH₂    (SEQ ID NO:164)

b3)   RNH-Val-Pro-Leu-Xaa₃-Arg-Thr-Val-Arg-Xaa₁-Thr-Xaa₂-Ile-Ser-Ile-(OH)NH₂    (SEQ ID NO:165)

b4)   RNH-Val-Pro-Leu-Ser-Xaa₃-Thr-Val-Arg-Xaa₁-Thr-Xaa₂-Ile-Ser-Ile-(OH)NH₂    (SEQ ID NO:166)

b5)   RNH-Val-Pro-Leu-Ser-Arg-Xaa₃-Val-Arg-Xaa₁-Thr-Xaa₂-Ile-Ser-Ile-(OH)NH₂    (SEQ ID NO:167)

b6)   RNH-Val-Pro-Leu-Ser-Arg-Thr-Xaa₃-Arg-Xaa₁-Thr-Xaa₂-Ile-Ser-Ile-(OH)NH₂    (SEQ ID NO:168)

b7)   RNH-Val-Pro-Leu-Ser-Arg-Thr-Val-Arg-Xaa₃-Xaa₁-Thr-Xaa₂-Ile-Ser-Ile-       (SEQ ID NO:169)
      (OH)NH₂

IP-10(1-17) acid or amide
b8)   RNH-Val-Pro-Leu-Ser-Arg-Thr-Val-Arg-Cys-Thr-Cys-Ile-Ser-Ile-Ser-Asn-Gln-  (SEQ ID NO:170)
      (OH)NH₂ b9)   RNH-Val-Pro-Xaa₃-Ser-Arg-Thr-Val-Arg-Xaa₁-Thr-Xaa₂-Ile-Ser-Ile-Ser-Asn-   (SEQ ID NO:171)
      Gln-(OH)NH₂ b10)  RNH-Val-Pro-Leu-Xaa₃-Arg-Thr-Val-Arg-Xaa₁-Thr-Xaa₂-Ile-Ser-Ile-Ser-Asn-   (SEQ ID NO:172)
      Gln-(OH)NH₂ b11)  RNH-Val-Pro-Leu-Ser-Xaa₃-Thr-Val-Arg-Xaa₁-Thr-Xaa₂-Ile-Ser-Ile-Ser-Asn-   (SEQ ID NO:173)
      Gln-(OH)NH₂ b12)  RNH-Val-Pro-Leu-Ser-Arg-Xaa₃-Val-Arg-Xaa₁-Thr-Xaa₂-Ile-Ser-Ile-Ser-Asn-   (SEQ ID NO:174)
      Gln-(OH)NH₂ b13)  RNH-Val-Pro-Leu-Ser-Arg-Thr-Xaa₃-Arg-Xaa₁-Thr-Xaa₂-Ile-Ser-Ile-Ser-Asn-   (SEQ ID NO:175)
      Gln-(OH)NH₂ b14)  RNH-Val-Pro-Leu-Ser-Arg-Thr-Val-Arg-Xaa₃-Xaa₁-Thr-Xaa₂-Ile-Ser-Ile-Ser-   (SEQ ID NO:176)
      Asn-Gln-(OH)NH₂
```

Preferred embodiments of linear IP-10 analogs of the present invention corresponding to a portion of the internal region of IP-10 having the following structures:

[A$^{11}$-]-IP-10-(11-35) acid or amide
b15) RNH-Ala-Ile-Ser-Ile-Ser-Asn-Gln-Pro-Val-Asn-Pro-Arg-Ser-Leu-Glu-Lys-Leu-   (SEQ ID NO:177)
     Glu-Ile-Ile-Pro-Ala-Ser-Gln-Phe-(OH)NH$_2$ Preferred embodiments of linear IP-10 analogs of the present invention corresponding to a portion of the N-terminal region and the internal region of IP-10 having the following structures:

IP-10-(1-35) acid or amide
b16) RNH-Val-Pro-Leu-Ser-Arg-Thr-Val-Arg-Cys-Thr-Cys-Ile-Ser-Ile-Ser-Asn-Gln-   (SEQ ID NO:178)
     Pro-Val-Asn-Pro-Arg-Ser-Leu-Glu-Lys-Leu-Glu-Ile-Ile-Pro-Ala-Ser-Gln-Phe-
     (OH)NH$_2$ b17) RNH-Xaa$_3$-Pro-Leu-Ser-Arg-Thr-Val-Arg-Xaa$_1$-Thr-Xaa$_2$-Ile-Ser-Ile-Ser-Asn-   (SEQ ID NO:179)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b18) RNH-Val-Xaa$_3$-Leu-Ser-Arg-Thr-Val-Arg-Xaa$_1$-Thr-Xaa$_2$-Ile-Ser-Ile-Ser-Asn-   (SEQ ID NO:180)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b19) RNH-Val-Pro-Xaa$_3$-Ser-Arg-Thr-Val-Arg-Xaa$_1$-Thr-Xaa$_2$-Ile-Ser-Ile-Ser-Asn-   (SEQ ID NO:181)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b20) RNH-Val-Pro-Leu-Xaa$_3$-Arg-Thr-Val-Arg-Xaa$_1$-Thr-Xaa$_2$-Ile-Ser-Ile-Ser-Asn-   (SEQ ID NO:182)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b21) RNH-Val-Pro-Leu-Ser-Xaa$_3$-Thr-Val-Arg-Xaa$_1$-Thr-Xaa$_2$-Ile-Ser-Ile-Ser-Asn-   (SEQ ID NO:183)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b22) RNH-Val-Pro-Leu-Ser-Arg-Xaa$_3$-Val-Arg-Xaa$_1$-Thr-Xaa$_2$-Ile-Ser-Ile-Ser-Asn-   (SEQ ID NO:184)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b23) RNH-Val-Pro-Leu-Ser-Arg-Thr-Xaa$_3$-Arg-Xaa$_1$-Thr-Xaa$_2$-Ile-Ser-Ile-Ser-Asn-   (SEQ ID NO:185)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ b24) RNH-Val-Pro-Leu-Ser-Arg-Thr-Val-Xaa$_3$-Xaa$_1$-Thr-Xaa$_2$-Ile-Ser-Ile-Ser-Asn-   (SEQ ID NO:186)
     Gln-Pro-Val-Asn-Pro-Arg-Ser-Leu-Glu-Lys-Leu-Glu-Ile-Ile-Pro-Ala-Ser-Gln-
     Phe-(OH)NH$_2$ Preferred embodiments of linear IP-10 analogs of the present invention corresponding to a portion of the C-terminal region of IP-10 having the following sequence:

IP-10-(53-77) acid or amide
b25) RNH-Leu-Asn-Pro-Glu-Ser-Lys-Ala-Ile-Lys-Asn-Leu-Leu-Lys-Ala-Val-Ser-Lys-   (SEQ ID NO:187)
     Glu-Met-Ser-Lys-Arg-Ser-Pro-(OH)NH$_2$ Preferred embodiments of cyclic IP-10 analogs of the present invention corresponding to a portion of the N-terminal region joined with a linker to a cyclic portion of the C-terminal region of IP-10 having the following structures:

IP-10-(1-14)-[linker]-IP-10-(65-77)-acid or amide b26) RNH-Val-Pro-Leu-Ser-Arg-Thr-Val-Arg-Cys-Thr-Cys-Ile-Ser-Ile-[linker]-Leu-Lys-Ala-Val-Ser-Lys-Glu-Met-Ser-Lys-Arg-Ser-Pro-(OH)$NH_2$ (SEQ ID NO:188)

b27) RNH-$Xaa_3$-Pro-Leu-Ser-Arg-Thr-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:189)

b28) RNH-Val-$Xaa_3$-Leu-Ser-Arg-Thr-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:190)

b29) RNH-Val-Pro-$Xaa_3$-Ser-Arg-Thr-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:191)

b30) RNH-Val-Pro-Leu-$Xaa_3$-Arg-Thr-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:192)

b31) RNH-Val-Pro-Leu-Ser-$Xaa_3$-Thr-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:193)

b32) RNH-Val-Pro-Leu-Ser-Arg-$Xaa_3$-Val-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:194)

b33) RNH-Val-Pro-Leu-Ser-Arg-Thr-$Xaa_3$-Arg-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:195)

b34) RNH-Val-Pro-Leu-Ser-Arg-Thr-Val-$Xaa_3$-$Xaa_1$-Thr-$Xaa_2$-Ile-Ser-Ile-[linker]-Leu-Lys-Ala-Val-Ser-Lys-Glu-Met-Ser-Lys-Arg-Ser-Pro-(OH)$NH_2$ (SEQ ID NO:196)

b35) RNH-Val-Pro-Leu-Ser-Arg-Thr-Val-Arg-Cys-Thr-Cys-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:197)

b36) RNH-$Xaa_3$-Pro-Leu-Ser-Arg-Thr-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:198)

b37) RNH-$Xaa_3$-Pro-Leu-Ser-Arg-Thr-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:199)

b38) RNH-Val-Pro-$Xaa_3$-Ser-Arg-Thr-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:200)

b39) RNH-Val-Pro-Leu-$Xaa_3$-Arg-Thr-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:201)

b40) RNH-Val-Pro-Leu-Ser-$Xaa_3$-Thr-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:202)

b41) RNH-Val-Pro-Leu-Ser-Arg-$Xaa_3$-Val-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:203)

b42) RNH-Val-Pro-Leu-Ser-Arg-Thr-$Xaa_3$-Arg-$Xaa_1$-Thr-$Xaa_2$-$Xaa_4$-Ser-Ile-[linker]-Leu-Lys-Ala-Val-Ser-Lys-Glu-Met-Ser-Lys-Arg-Ser-Pro-(OH)$NH_2$ (SEQ ID NO:204)

b43) RNH-Val-Pro-Leu-Ser-Arg-Thr-Val-$Xaa_3$-$Xaa_1$-Thr-$Xaa_2$-$Xaa_1$-Ser-Ile-[linker]-Leu-Lys-Ala-Val-Ser-Lys-Glu-Met-Ser-Lys-Arg-Ser-Pro-(OH)$NH_2$ (SEQ ID NO:205)

b44) RNH-Val-Pro-Leu-Ser-Arg-Thr-Val-Arg-Cys-Thr-Cys-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:206)

b45) RNH-$Xaa_3$-Pro-Leu-Ser-Arg-Thr-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:207)

b46) RNH-Val-$Xaa_3$-Leu-Ser-Arg-Thr-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:208)

b47) RNH-Val-Pro-$Xaa_3$-Ser-Arg-Thr-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:209)

b48) RNH-Val-Pro-Leu-$Xaa_3$-Arg-Thr-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:210)

b49) RNH-Val-Pro-Leu-Ser-$Xaa_3$-Thr-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:211)

b50) RNH-Val-Pro-Leu-Ser-Arg-$Xaa_3$-Val-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:212)

b51) RNH-Val-Pro-Leu-Ser-Arg-Thr-$Xaa_3$-Arg-$Xaa_1$-Thr-$Xaa_2$-Ile-$Xaa_4$-Ile-[linker]-Leu-Lys-Ala-Val-Ser-Lys-Glu-Met-Ser-Lys-Arg-Ser-Pro-(OH)$NH_2$ (SEQ ID NO:213)

| | | |
|---|---|---|
| b52) | RNH-Val-Pro-Leu-Ser-Arg-Thr-Val-Xaa$_3$-Xaa$_1$-Thr-Xaa$_2$-Ile-Xaa$_4$-Ile-[linker]-Leu-Lys-Ala-Val-Ser-Lys-Glu-Met-Ser-Lys-Arg-Ser-Pro-(OH)NH$_2$ | (SEQ ID NO:214) |
| b53) | RNH-Val-Pro-Leu-Ser-Arg-Thr-Val-Arg-Cys-Thr-Cys-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:215) |
| b54) | RNH-Xaa$_3$-Pro-Leu-Ser-Arg-Thr-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:216) |
| b55) | RNH-Val-Xaa$_3$-Leu-Ser-Arg-Thr-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:217) |
| b56) | RNH-Val-Pro-Xaa$_3$-Ser-Arg-Thr-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:218) |
| b57) | RNH-Val-Pro-Leu-Xaa$_3$-Arg-Thr-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:219) |
| b58) | RNH-Val-Pro-Leu-Ser-Xaa$_3$-Thr-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:220) |
| b59) | RNH-Val-Pro-Leu-Ser-Arg-Xaa$_3$-Val-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:221) |
| b60) | RNH-Val-Pro-Leu-Ser-Arg-Thr-Xaa$_3$-Arg-Xaa$_1$-Thr-Xaa$_2$-Ile-Ser-Xaa$_4$-[linker]-Leu-Lys-Ala-Val-Ser-Lys-Glu-Met-Ser-Lys-Arg-Ser-Pro-(OH)NH$_2$ | (SEQ ID NO:222) |
| b61) | RNH-Val-Pro-Leu-Ser-Arg-Thr-Val-Xaa$_3$-Xaa$_1$-Thr-Xaa$_2$-Ile-Ser-Xaa$_1$-[linker]-Leu-Lys-Ala-Val-Ser-Lys-Glu-Met-Ser-Lys-Arg-Ser-Pro-(OH)NH$_2$ | (SEQ ID NO:223) |

IP-10-(1-14)-[linker]-IP-10-(54-66)-acid or amide

| | | |
|---|---|---|
| b62) | RNH-Val-Pro-Leu-Ser-Arg-Thr-Val-Arg-Cys-Thr-Cys-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:224) |
| b63) | RNH-Xaa$_3$-Pro-Leu-Ser-Arg-Thr-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:225) |
| b64) | RNH-Val-Xaa$_3$-Leu-Ser-Arg-Thr-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:226) |
| b65) | RNH-Val-Pro-Xaa$_3$-Ser-Arg-Thr-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:227) |
| b66) | RNH-Val-Pro-Leu-Xaa$_3$-Arg-Thr-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:228) |
| b67) | RNH-Val-Pro-Leu-Ser-Xaa$_3$-Thr-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:229) |
| b68) | RNH-Val-Pro-Leu-Ser-Arg-Xaa$_3$-Val-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:230) |
| b69) | RNH-Val-Pro-Leu-Ser-Arg-Thr-Xaa$_3$-Arg-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:231) |
| b70) | RNH-Val-Pro-Leu-Ser-Arg-Thr-Val-Xaa$_3$-Xaa$_1$-Thr-Xaa$_2$-Ile-Ser-Ile-[linker]-Leu-Asn-Pro-Glu-Ser-Lys-Ala-Ile-Lys-Asn-Leu-Leu-Lys-(OH)NH$_2$ | (SEQ ID NO:232) |
| b71) | RNH-Val-Pro-Leu-Ser-Arg-Thr-Val-Arg-Cys-Thr-Cys-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:233) |
| b72) | RNH-Xaa$_3$-Pro-Leu-Ser-Arg-Thr-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:234) |
| b73) | RNH-Val-Xaa$_3$-Leu-Ser-Arg-Thr-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:235) |
| b74) | RNH-Val-Pro-Xaa$_3$-Ser-Arg-Thr-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:236) |
| b75) | RNH-Val-Pro-Leu-Xaa$_3$-Arg-Thr-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:237) |
| b76) | RNH-Val-Pro-Leu-Ser-Xaa$_3$-Thr-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:238) |
| b77) | RNH-Val-Pro-Leu-Ser-Arg-Xaa$_3$-Val-Arg-Xaa$_1$-Thr-Xaa$_2$-Xaa$_4$-Ser-Ile-[linker]-Leu-Asn-Pro-Glu-Ser-Lys-Ala-Ile-Lys-Asn-Leu-Leu-Lys-(OH)NH$_2$ | (SEQ ID NO:239) |

-continued b78) RNH-Val-Pro-Leu-Ser-Arg-Thr-Xaa₁-Arg-Xaa₂-Xaa₄-Ser-Ile-[linker]-Leu- (SEQ ID NO:240)
Asn-Pro-Glu-Ser-Lys-Ala-Ile-Lys-Asn-Leu-Leu-Lys-(OH)NH₂ b79) RNH-Val-Pro-Leu-Ser-Arg-Thr-Val-Xaa₃-Xaa₁-Thr-Xaa₂-Xaa₄-Ser-Ile-[linker]-Leu- (SEQ ID NO:241)
Asn-Pro-Glu-Ser-Lys-Ala-Ile-Lys-Asn-Leu-Leu-Lys-(OH)NH₂ b80) RNH-Val-Pro-Leu-Ser-Arg-Thr-Val-Arg-Cys-Thr-Cys-Ile-Xaa₄-Ile-[linker]-Leu-Asn- (SEQ ID NO:242)
Pro-Glu-Ser-Lys-Ala-Ile-Lys-Asn-Leu-Leu-Lys-(OH)NH₂ b81) RNH-Xaa₃-Pro-Leu-Ser-Arg-Thr-Val-Arg-Xaa₁-Thr-Xaa₂-Ile-Xaa₄-Ile-[linker]-Leu- (SEQ ID NO:243)
Asn-Pro-Glu-Ser-Lys-Ala-Ile-Lys-Asn-Leu-Leu-Lys-(OH)NH₂ b82) RNH-Val-Xaa₃-Leu-Ser-Arg-Thr-Val-Arg-Xaa₁-Thr-Xaa₂-Ile-Xaa₄-Ile-[linker]-Leu- (SEQ ID NO:244)
Asn-Pro-Glu-Ser-Lys-Ala-Ile-Lys-Asn-Leu-Leu-Lys-(OH)NH₂ b83) RNH-Val-Pro-Xaa₃-Ser-Arg-Thr-Val-Arg-Xaa₁-Thr-Xaa₂-Ile-Xaa₁-Ile-[linker]-Leu- (SEQ ID NO:245)
Asn-Pro-Glu-Ser-Lys-Ala-Ile-Lys-Asn-Leu-Leu-Lys-(OH)NH₂ b84) RNH-Val-Pro-Leu-Xaa₃-Arg-Thr-Val-Arg-Xaa₁-Thr-Xaa₂-Ile-Xaa₄-Ile-[linker]-Leu- (SEQ ID NO:246)
Asn-Pro-Glu-Ser-Lys-Ala-Ile-Lys-Asn-Leu-Leu-Lys-(OH)NH₂ b85) RNH-Val-Pro-Leu-Ser-Xaa₃-Thr-Val-Arg-Xaa₁-Thr-Xaa₂-Ile-Xaa₄-Ile-[linker]-Leu- (SEQ ID NO:247)
Asn-Pro-Glu-Ser-Lys-Ala-Ile-Lys-Asn-Leu-Leu-Lys-(OH)NH₂ b86) RNH-Val-Pro-Leu-Ser-Arg-Xaa₃-Val-Arg-Xaa₁-Thr-Xaa₂-Ile-Xaa₄-Ile-[linker]-Leu- (SEQ ID NO:248)
Asn-Pro-Glu-Ser-Lys-Ala-Ile-Lys-Asn-Leu-Leu-Lys-(OH)NH₂ b87) RNH-Val-Pro-Leu-Ser-Arg-Thr-Xaa₃-Arg-Xaa₁-Thr-Xaa₂-Ile-Xaa₄-Ile-[linker]-Leu- (SEQ ID NO:249)
Asn-Pro-Glu-Ser-Lys-Ala-Ile-Lys-Asn-Leu-Leu-Lys(OH)NH₂ b88) RNH-Val-Pro-Leu-Ser-Arg-Thr-Val-Xaa₃-Xaa₁-Thr-Xaa₂-Ile-Xaa₄-Ile-[linker]-Leu- (SEQ ID NO:250)
Asn-Pro-Glu-Ser-Lys-Ala-Ile-Lys-Asn-Leu-Leu-Lys(OH)NH₂ b89) RNH-Val-Pro-Leu-Ser-Arg-Thr-Val-Arg-Cys-Thr-Cys-Ile-Ser-Xaa₄-[linker]-Leu-Asn- (SEQ ID NO:251)
Pro-Glu-Ser-Lys-Ala-Ile-Lys-Asn-Leu-Leu-Lys(OH)NH₂ b90) RNH-Xaa₃-Pro-Leu-Ser-Arg-Thr-Val-Arg-Xaa₁-Thr-Xaa₂-Ile-Ser-Xaa₄-[linker]-Leu- (SEQ ID NO:252)
Asn-Pro-Glu-Ser-Lys-Ala-Ile-Lys-Asn-Leu-Leu-Lys-(OH)NH₂ b91) RNH-Val-Xaa₃-Leu-Ser-Arg-Thr-Val-Arg-Xaa₁-Thr-Xaa₂-Ile-Ser-Xaa₄-[linker]-Leu- (SEQ ID NO:253)
Asn-Pro-Glu-Ser-Lys-Ala-Ile-Lys-Asn-Leu-Leu-Lys-(OH)NH₂ b92) RNH-Val-Pro-Xaa₃-Ser-Arg-Thr-Val-Arg-Xaa₁-Thr-Xaa₂-Ile-Ser-Xaa₄-[linker]-Leu- (SEQ ID NO:254)
Asn-Pro-Glu-Ser-Lys-Ala-Ile-Lys-Asn-Leu-Leu-Lys-(OH)NH₂ b93) RNH-Val-Pro-Leu-Xaa₃-Arg-Thr-Val-Arg-Xaa₁-Thr-Xaa₂-Ile-Ser-Xaa₄-[linker]-Leu- (SEQ ID NO:255)
Asn-Pro-Glu-Ser-Lys-Ala-Ile-Lys-Asn-Leu-Leu-Lys(OH)NH₂ b94) RNH-Val-Pro-Leu-Ser-Xaa₃-Thr-Val-Arg-Xaa₁-Thr-Xaa₂-Ile-Ser-Xaa₄-[linker]-Leu- (SEQ ID NO:256)
Asn-Pro-Glu-Ser-Lys-Ala-Ile-Lys-Asn-Leu-Leu-Lys-(OH)NH₂ b95) RNH-Val-Pro-Leu-Ser-Arg-Xaa₃-Val-Arg-Xaa₁-Thr-Xaa₂-Ile-Ser-Xaa₄-[linker]-Leu- (SEQ ID NO:257)
Asn-Pro-Glu-Ser-Lys-Ala-Ile-Lys-Asn-Leu-Leu-Lys(OH)NH₂ b96) RNH-Val-Pro-Leu-Ser-Arg-Thr-Xaa₃-Arg-Xaa₁-Thr-Xaa₂-Ile-Ser-Xaa₄-[linker]-Leu- (SEQ ID NO:258)
Asn-Pro-Glu-Ser-Lys-Ala-Ile-Lys-Asn-Leu-Leu-Lys-(OH)NH₂ b97) RNH-Val-Pro-Leu-Ser-Arg-Thr-Val-Xaa₃-Xaa₁-Thr-Xaa₂-Ile-Ser-Xaa₄-[linker]-Leu- (SEQ ID NO:259)
Asn-Pro-Glu-Ser-Lys-Ala-Ile-Lys-Asn-Leu-Leu-Lys-(OH)NH₂

IP-10-(1-14)-[linker]-IP-10-(59-71)-acid or amide
b98) RNH-Val-Pro-Leu-Ser-Arg-Thr-Val-Arg-Cys-Cys-Ile-Ser-Ile-[linker]-Lys-Ala- (SEQ ID NO:260)
Ile-Lys-Asn-Leu-Leu-Lys-Ala-Val-Ser-Lys-Glu-(OH)NH₂ b99) RNH-Xaa₃-Pro-Leu-Ser-Arg-Thr-Val-Arg-Xaa₁-Thr-Xaa₂-Ile-Ser-Ile-[linker]-Lys- (SEQ ID NO:261)
Ala-Ile-Lys-Asn-Leu-Leu-Lys-Ala-Val-Ser-Lys-Glu-(OH)NH₂ b100) RNH-Val-Xaa₃-Leu-Ser-Arg-Thr-Val-Arg-Xaa₁-Thr-Xaa₂-Ile-Ser-Ile -[linker]-Lys- (SEQ ID NO:262)
Ala-Ile-Lys-Asn-Leu-Leu-Lys-Ala-Val-Ser-Lys-Glu-(OH)NH₂ b101) RNH-Val-Pro Xaa₃-Ser-Arg-Thr-Val-Arg-Xaa₁-Thr-Xaa₂-Ile-Ser-Ile-[linker]-Lys- (SEQ ID NO:263)
Ala-Ile-Lys-Asn-Leu-Leu-Lys-Ala-Val-Ser-Lys-Glu-(OH)NH₂ b102) RNH-Val-Pro-Leu-Xaa₃-Arg-Thr-Val-Arg-Xaa₁-Thr-Xaa₂-Ile-Ser-Ile-[linker]-Lys- (SEQ ID NO:264)
Ala-Ile-Lys-Asn-Leu-Leu-Lys-Ala-Val-Ser-Lys-Glu-(OH)NH₂ b103) RNH-Val-Pro-Leu-Ser-Xaa₃-Thr-Val-Arg-Xaa₁-Thr-Xaa₂-Ile-Ser-Ile-[linker]-Lys- (SEQ ID NO:265)
Ala-Ile-Lys-Asn-Leu-Leu-Lys-Ala-Val-Ser-Lys-Glu-(OH)NH₂

-continued b104) RNH-Val-Pro-Leu-Ser-Arg-Xaa₃-Val-Arg-Xaa₁-Thr-Xaa₂-Ile-Ser-Ile-[linker]-Lys- (SEQ ID NO:266)
Ala-Ile-Lys-Asn-Leu-Leu-Lys-Ala-Val-Ser-Lys-Glu-(OH)NH₂ b105) RNH-Val-Pro-Leu-Ser-Arg-Thr-Xaa₃-Arg-Xaa₁-Thr-Xaa₂-Ile-Ser-Ile-[linker]-Lys- (SEQ ID NO:267)
Ala-Ile-Lys-Asn-Leu-Leu-Lys-Ala-Val-Ser-Lys-Glu-(OH)NH₂ b106) RNH-Val-Pro-Leu-Ser-Arg-Thr-Val-Xaa₃-Xaa₁-Thr-Xaa₂-Ile-Ser-Ile-[linker]-Lys- (SEQ ID NO:268)
Ala-Ile-Lys-Asn-Leu-Leu-Lys-Ala-Val-Ser-Lys-Glu-(OH)NH₂ b107) RNH-Val-Pro-Leu-Ser-Arg-Thr-Val-Arg-Cys-Thr-Cys-Xaa₂-Ser-Ile [linker]-Lys- (SEQ ID NO:269)
Ala-Ile-Lys-Asn-Leu-Leu-Lys-Ala-Val-Ser-Lys-Glu-(OH)NH₂ b108) RNH-Xaa₃-Pro-Leu-Ser-Arg-Thr-Val-Arg-Xaa₁-Thr-Xaa₂-Xaa₄-Ser-Ile-[linker]-Lys- (SEQ ID NO:270)
Ala-Ile-Lys-Asn-Leu-Leu-Lys-Ala-Val-Ser-Lys-Glu-(OH)NH₂ b109) RNH-Val-Xaa₃-Leu-Ser-Arg-Thr-Val-Arg-Xaa₁-Thr-Xaa₂-Xaa₄-Ser-Ile-[linker]-Lys- (SEQ ID NO:271)
Ala-Ile-Lys-Asn-Leu-Leu-Lys-Ala-Val-Ser-Lys-Glu-(OH)NH₂ b110) RNH-Val-Pro-Xaa₃-Ser-Arg-Thr-Val-Arg-Xaa₁-Thr-Xaa₂-Xaa₄-Ser-Ile-[linker]-Lys- (SEQ ID NO:272)
Ala-Ile-Lys-Asn-Leu-Leu-Lys-Ala-Val-Ser-Lys-Glu-(OH)NH₂ b111) RNH-Val-Pro-Leu-Xaa₃-Arg-Thr-Val-Arg-Xaa₁-Thr-Xaa₂-Xaa₄-Ser-Ile-[linker]-Lys- (SEQ ID NO:273)
Ala-Ile-Lys-Asn-Leu-Leu-Lys-Ala-Val-Ser-Lys-Glu-(OH)NH₂ b112) RNH-Val-Pro-Leu-Ser-Xaa₃-Thr-Val-Arg-Xaa₁-Thr-Xaa₂-Xaa₄-Ser-Ile-[linker]-Lys- (SEQ ID NO:274)
Ala-Ile-Lys-Asn-Leu-Leu-Lys-Ala-Val-Ser-Lys-Glu-(OH)NH₂ b113) RNH-Val-Pro-Leu-Ser-Arg-Xaa₃-Val-Arg-Xaa₁-Thr-Xaa₂-Xaa₄-Ser-Ile-[linker]-Lys- (SEQ ID NO:275)
Ala-Ile-Lys-Asn-Leu-Leu-Lys-Ala-Val-Ser-Lys-Glu-(OH)NH₂ b114) RNH-Val-Pro-Leu-Ser-Arg-Thr-Xaa₃-Arg-Xaa₁-Thr-Xaa₂-Xaa₄-Ser-Ile-[linker]-Lys- (SEQ ID NO:276)
Ala-Ile-Lys-Asn-Leu-Leu-Lys-Ala-Val-Ser-Lys-Glu-(OH)NH₂ b115) RNH-Val-Pro-Leu-Ser-Arg-Thr-Val-Xaa₃-Xaa₁-Thr-Xaa₂-Xaa₁-Ser-Ile-[linker]-Lys- (SEQ ID NO:277)
Ala-Ile-Lys-Asn-Leu-Leu-Lys-Ala-Val-Ser-Lys-Glu-(OH)NH₂ b116) RNH-Val-Pro-Leu-Ser-Arg-Thr-Val-Arg-Cys-Thr-Cys-Ile-Xaa₄-Ile [linker]-Lys- (SEQ ID NO:278)
Ala-Ile-Lys-Asn-Leu-Leu-Lys-Ala-Val-Ser-Lys-Glu-(OH)NH₂ b117) RNH-Xaa₃-Pro-Leu-Ser-Arg-Thr-Val-Arg-Xaa₁-Thr-Xaa₂-Ile-Xaa₄-Ile-[linker]-Lys- (SEQ ID NO:279)
Ala-Ile-Lys-Asn-Leu-Leu-Lys-Ala-Val-Ser-Lys-Glu-(OH)NH₂ b118) RNH-Val-Xaa₃-Leu-Ser-Arg-Thr-Val-Arg-Xaa₁-Thr-Xaa₂-Ile-Xaa₄-Ile-[linker]-Lys- (SEQ ID NO:280)
Ala-Ile-Lys-Asn-Leu-Leu-Lys-Ala-Val-Ser-Lys-Glu-(OH)NH₂ b119) RNH-Val-Pro-Xaa₃-Ser-Arg-Thr-Val-Arg-Xaa₁-Thr-Xaa₂-Ile-Xaa₄-Ile-[linker]-Lys- (SEQ ID NO:281)
Ala-Ile-Lys-Asn-Leu-Leu-Lys-Ala-Val-Ser-Lys-Glu-(OH)NH₂ b120) RNH-Val-Pro-Leu-Xaa₃-Arg-Thr-Val-Arg-Xaa₁-Thr-Xaa₂-Ile-Xaa₄-Ile-[linker]-Lys- (SEQ ID NO:282)
Ala-Ile-Lys-Asn-Leu-Leu-Lys-Ala-Val-Ser-Lys-Glu-(OH)NH₂ b121) RNH-Val-Pro-Leu-Ser-Xaa₃-Thr-Val-Arg-Xaa₁-Thr-Xaa₂-Ile-Xaa₄-Ile-[linker]-Lys- (SEQ ID NO:283)
Ala-Ile-Lys-Asn-Leu-Leu-Lys-Ala-Val-Ser-Lys-Glu(OH)NH₂ b122) RNH-Val-Pro-Leu-Ser-Arg-Xaa₃-Val-Arg-Xaa₁-Thr-Xaa₂-Ile-Xaa₄-Ile-[linker]-Lys- (SEQ ID NO:284)
Ala-Ile-Lys-Asn-Leu-Leu-Lys-Ala-Val-Ser-Lys-Glu-(OH)NH₂ b123) RNH-Val-Pro-Leu-Ser-Arg-Thr-Xaa₃-Arg-Xaa₁-Thr-Xaa₂-Ile-Xaa₄-Ile-[linker]-Lys- (SEQ ID NO:285)
Ala-Ile-Lys-Asn-Leu-Leu-Lys-Ala-Val-Ser-Lys-Glu-(OH)NH₂ b124) RNH-Val-Pro-Leu-Ser-Arg-Thr-Val-Xaa₃-Xaa₁-Thr-Xaa₂-Ile-Xaa₄-Ile-[linker]-Lys- (SEQ ID NO:286)
Ala-Ile-Lys-Asn-Leu-Leu-Lys-Ala-Val-Ser-Lys-Glu-(OH)NH₂ b125) RNH-Val-Pro-Leu-Ser-Arg-Thr-Val-Arg-Cys-Thr-Cys-Ile-Ser-Xaa₄-[linker]-Lys- (SEQ ID NO:287)
Ala-Ile-Lys-Asn-Leu-Leu-Lys-Ala-Val-Ser-Lys-Glu-(OH)NH₂ b126) RNH-Xaa₃-Pro-Leu-Ser-Arg-Thr-Val-Arg-Xaa₁-Thr-Xaa₂-Ile-Ser-Xaa₄-[linker]-Lys- (SEQ ID NO:288)
Ala-Ile-Lys-Asn-Leu-Leu-Lys-Ala-Val-Ser-Lys-Glu-(OH)NH₂ b127) RNH-Val-Xaa₃-Leu-Ser-Arg-Thr-Val-Arg-Xaa₁-Thr-Xaa₂-Ile-Ser-Xaa₄-[linker]-Lys- (SEQ ID NO:289)
Ala-Ile-Lys-Asn-Leu-Leu-Lys-Ala-Val-Ser-Lys-Glu-(OH)NH₂ b128) RNH-Val-Pro-Xaa₃-Ser-Arg-Thr-Val-Arg-Xaa₁-Thr-Xaa₂-Ile-Ser-Xaa₄-[linker]-Lys- (SEQ ID NO:290)
Ala-Ile-Lys-Asn-Leu-Leu-Lys-Ala-Val-Ser-Lys-Glu-(OH)NH₂ b129) RNH-Val-Pro-Leu-Xaa₃-Arg-Thr-Val-Arg-Xaa₁-Thr-Xaa₂-Ile-Ser-Xaa₄-[linker]-Lys- (SEQ ID NO:291)
Ala-Ile-Lys-Asn-Leu-Leu-Lys-Ala-Val-Ser-Lys-Glu-(OH)NH₂

-continued b130) RNH-Val-Pro-Leu-Ser-Xaa$_3$-Thr-Val-Arg-Xaa$_1$-Thr-Xaa$_2$-Ile-Ser-Xaa$_4$- [linker]-Lys- (SEQ ID NO:292)
Ala-Ile-Lys-Asn-Leu-Leu-Lys-Ala-Val-Ser-Lys-Glu-(OH)NH$_2$ b131) RNH-Val-Pro-Leu-Ser-Arg-Xaa$_3$-Val-Arg-Xaa$_1$-Thr-Xaa$_2$-Ile-Ser-Xaa$_4$-[linker]-Lys- (SEQ ID NO:293)
Ala-Ile-Lys-Asn-Leu-Leu-Lys-Ala-Val-Ser-Lys-Glu-(OH)NH$_2$ b132) RNH-Val-Pro-Leu-Ser-Arg-Thr-Xaa$_3$-Arg-Xaa$_1$-Thr-Xaa$_2$-Ile-Ser-Xaa$_4$-[linker]-Lys- (SEQ ID NO:294)
Ala-Ile-Lys-Asn-Leu-Leu-Lys-Ala-Val-Ser-Lys-Glu-(OH)NH$_2$ b133) RNH-Val-Pro-Leu-Ser-Arg-Thr-Val-Xaa$_3$-Xaa$_1$-Thr-Xaa$_2$-Ile-Ser-Xaa$_4$-[linker]-Lys- (SEQ ID NO:295)
Ala-Ile-Lys-Asn-Leu-Leu-Lys-Ala-Val-Ser-Lys-Glu-(OH)NH$_2$ IP-10-(1-17)-[linker]-IP-10-(65-77)-acid or amide b134) RNH-Val-Pro-Leu-Ser-Arg-Thr-Val-Arg-Cys-Thr-Cys-Ile-Ser-Ile-Ser-Asn-Gln- (SEQ ID NO:296)
[linker]-Leu-Lys-Ala-Val-Ser-Lys-Glu-Met-Ser-Lys-Arg-Ser-Pro-(OH)NH$_2$ b135) RNH-Xaa$_3$-Pro-Leu-Ser-Arg-Thr-Val-Arg-Xaa$_1$-Thr-Xaa$_2$-Ile-Ser-Ile-Ser-Asn-Gln- (SEQ ID NO:297)
[linker]-Leu-Lys-Ala-Val-Ser-Lys-Glu-Met-Ser-Lys-Arg-Ser-Pro-(OH)NH$_2$ b136) RNH-Val-Xaa$_3$-Leu-Ser-Arg-Thr-Val-Arg-Xaa$_1$-Thr-Xaa$_2$-Ile-Ser-Ile-Ser-Asn-Gln- (SEQ ID NO:298)
[linker]-Leu-Lys-Ala-Val-Ser-Lys-Glu-Met-Ser-Lys-Arg-Ser-Pro-(OH)NH$_2$ b137) RNH-Val-Pro-Xaa$_3$-Ser-Arg-Thr-Val-Arg-Xaa$_1$-Thr-Xaa$_2$-Ile-Ser-Ile-Ser-Asn-Gln- (SEQ ID NO:299)
[linker]-Leu-Lys-Ala-Val-Ser-Lys-Glu-Met-Ser-Lys-Arg-Ser-Pro-(OH)NH$_2$ b138) RNH-Val-Pro-Leu-Xaa$_3$-Arg-Thr-Val-Arg-Xaa$_1$-Thr-Xaa$_2$-Ile-Ser-Ile-Ser-Asn-Gln- (SEQ ID NO:300)
[linker]-Leu-Lys-Ala-Val-Ser-Lys-Glu-Met-Ser-Lys-Arg-Ser-Pro-(OH)NH$_2$ b139) RNH-Val-Pro-Leu-Ser-Xaa$_3$-Thr-Val-Arg-Xaa$_1$-Thr-Xaa$_2$-Ile-Ser-Ile-Ser-Asn-Gln- (SEQ ID NO:301)
[linker]-Leu-Lys-Ala-Val-Ser-Lys-Glu-Met-Ser-Lys-Arg-Ser-Pro-(OH)NH$_2$ b140) RNH-Val-Pro-Leu-Ser-Arg-Xaa$_3$-Val-Arg-Xaa$_1$-Thr-Xaa$_2$-Ile-Ser-Ile-Ser-Asn-Gln- (SEQ ID NO:302)
[linker]-Leu-Lys-Ala-Val-Ser-Lys-Glu-Met-Ser-Lys-Arg-Ser-Pro-(OH)NH$_2$ b141) RNH-Val-Pro-Leu-Ser-Arg-Thr-Xaa$_3$-Arg-Xaa$_1$-Thr-Xaa$_2$-Ile-Ser-Ile-Ser-Asn-Gln- (SEQ ID NO:303)
[linker]-Leu-Lys-Ala-Val-Ser-Lys-Glu-Met-Ser-Lys-Arg-Ser-Pro-(OH)NH$_2$ b142) RNH-Val-Pro-Leu-Ser-Arg-Thr-Val-Xaa$_3$-Xaa$_1$-Thr-Xaa$_2$-Ile-Ser-Ile-Ser-Asn-Gln- (SEQ ID NO:304)
[linker]-Leu-Lys-Ala-Val-Ser-Lys-Glu-Met-Ser-Lys-Arg-Ser-Pro-(OH)NH$_2$ b143) RNH-Val-Pro-Leu-Ser-Arg-Thr-Val-Arg-Cys-Thr-Cys-Xaa$_4$-Ser-Ile-Ser-Asn-Gln- (SEQ ID NO:305)
[linker]-Leu-Lys-Ala-Val-Ser-Lys-Glu-Met-Ser-Lys-Arg-Ser-Pro-(OH)NH$_2$ b144) RNH-Xaa$_3$-Pro-Leu-Ser-Arg-Thr-Val-Arg-Xaa$_1$-Thr-Xaa$_2$-Xaa$_4$-Ser-Ile-Ser-Asn-Gln- (SEQ ID NO:306)
[linker]-Leu-Lys-Ala-Val-Ser-Lys-Glu-Met-Ser-Lys-Arg-Ser-Pro-(OH)NH$_2$ b145) RNH-Val-Xaa$_3$-Leu-Ser-Arg-Thr-Val-Arg-Xaa$_1$-Thr-Xaa$_2$-Xaa$_4$-Ser-Ile-Ser-Asn-Gln- (SEQ ID NO:307)
[linker]-Leu-Lys-Ala-Val-Ser-Lys-Glu-Met-Ser-Lys-Arg-Ser-Pro-(OH)NH$_2$ b146) RNH-Val-Pro-Xaa$_3$-Ser-Arg-Thr-Val-Arg-Xaa$_1$-Thr-Xaa$_2$-Xaa$_4$-Ser-Ile-Ser-Asn-Gln- (SEQ ID NO:308)
[linker]-Leu-Lys-Ala-Val-Ser-Lys-Glu-Met-Ser-Lys-Arg-Ser-Pro-(OH)NH$_2$ b147) RNH-Val-Pro-Leu-Xaa$_3$-Arg-Thr-Val-Arg-Xaa$_1$-Thr-Xaa$_2$-Xaa$_4$-Ser-Ile-Ser-Asn-Gln- (SEQ ID NO:309)
[linker]-Leu-Lys-Ala-Val-Ser-Lys-Glu-Met-Ser-Lys-Arg-Ser-Pro-(OH)NH$_2$ b148) RNH-Val-Pro-Leu-Ser-Xaa$_3$-Thr-Val-Arg-Xaa$_1$-Thr-Xaa$_2$-Xaa$_4$-Ser-Ile-Ser-Asn-Gln- (SEQ ID NO:310)
[linker]-Leu-Lys-Ala-Val-Ser-Lys-Glu-Met-Ser-Lys-Arg-Ser-Pro-(OH)NH$_2$ b149) RNH-Val-Pro-Leu-Ser-Arg-Xaa$_3$-Val-Arg-Xaa$_1$-Thr-Xaa$_2$-Xaa$_4$-Ser-Ile-Ser-Asn-Gln- (SEQ ID NO:311)
[linker]-Leu-Lys-Ala-Val-Ser-Lys-Glu-Met-Ser-Lys-Arg-Ser-Pro-(OH)NH$_2$ b150) RNH-Val-Pro-Leu-Ser-Arg-Thr-Xaa$_3$-Arg-Xaa$_1$-Thr-Xaa$_2$-Xaa$_4$-Ser-Ile-Ser-Asn-Gln- (SEQ ID NO:312)
[linker]-Leu-Lys-Ala-Val-Ser-Lys-Glu-Met-Ser-Lys-Arg-Ser-Pro-(OH)NH$_2$ b151) RNH-Val-Pro-Leu-Ser-Arg-Thr-Val-Xaa$_3$-Xaa-Thr-Xaa$_2$-Xaa$_4$-Ser-Ile-Ser-Asn-Gln- (SEQ ID NO:313)
[linker]-Leu-Lys-Ala-Val-Ser-Lys-Glu-Met-Ser-Lys-Arg-Ser-Pro-(OH)NH$_2$ b152) RNH-Val-Pro-Leu-Ser-Arg-Thr-Val-Arg-Cys-Thr-Cys-Ile-Xaa$_4$-Ile-Ser-Asn-Gln- (SEQ ID NO:314)
[linker]-Leu-Lys-Ala-Val-Ser-Lys-Glu-Met-Ser-Lys-Arg-Ser-Pro-(OH)NH$_2$ b153) RNH-Xaa$_3$-Pro-Leu-Ser-Arg-Thr-Val-Arg-Xaa$_1$-Thr-Xaa$_2$-Ile-Xaa$_4$-Ile-Ser-Asn-Gln- (SEQ ID NO:315)
[linker]-Leu-Lys-Ala-Val-Ser-Lys-Glu-Met-Ser-Lys-Arg-Ser-Pro-(OH)NH$_2$ b154) RNH-Val-Xaa$_3$-Leu-Ser-Arg-Thr-Val-Arg-Xaa$_1$-Thr-Xaa$_2$-Ile-Xaa$_4$-Ile-Ser-Asn-Gln- (SEQ ID NO:316)
[linker]-Leu-Lys-Ala-Val-Ser-Lys-Glu-Met-Ser-Lys-Arg-Ser-Pro-(OH)NH$_2$ b155) RNH-Val-Pro-Xaa$_3$-Ser-Arg-Thr-Val-Arg-Xaa$_1$-Thr-Xaa$_2$-Ile-Xaa$_4$-Ile-Ser-Asn-Gln- (SEQ ID NO:317)
[linker]-Leu-Lys-Ala-Val-Ser-Lys-Glu-Met-Ser-Lys-Arg-Ser-Pro-(OH)NH$_2$ -continued b156) RNH-Val-Pro-Leu-Xaa$_3$-Arg-Thr-Val-Arg-Xaa$_1$-Thr-Xaa$_2$-Ile-Xaa$_4$-Ile-Ser-Asn-Gln- (SEQ ID NO:318)
[linker]-Leu-Lys-Ala-Val-Ser-Lys-Glu-Met-Ser-Lys-Arg-Ser-Pro-(OH)NH$_2$ b157) RNH-Val-Pro-Leu-Ser-Xaa$_3$-Thr-Val-Arg-Xaa$_1$-Thr-Xaa$_2$-Ile-Xaa$_4$-Ile-Ser-Asn-Gln- (SEQ ID NO:319)
linker]-Leu-Lys-Ala-Val-Ser-Lys-Glu-Met-Ser-Lys-Arg-Ser-Pro-(OH)NH$_2$ b158) RNH-Val-Pro-Leu-Ser-Arg-Xaa$_3$-Val-Arg-Xaa$_1$-Thr-Xaa$_2$-Ile-Xaa$_4$-Ile-Ser-Asn-Gln- (SEQ ID NO:320)
[linker]-Leu-Lys-Ala-Val-Ser-Lys-Glu-Met-Ser-Lys-Arg-Ser-Pro-(OH)NH$_2$ b159) RNH-Val-Pro-Leu-Ser-Arg-Thr-Xaa$_3$-Arg-Xaa$_1$-Thr-Xaa$_2$-Ile-Xaa$_4$-Ile-Ser-Asn-Gln- (SEQ ID NO:321)
[linker]-Leu-Lys-Ala-Val-Ser-Lys-Glu-Met-Ser-Lys-Arg-Ser-Pro-(OH)NH$_2$ b160) RNH-Val-Pro-Leu-Ser-Arg-Thr-Val-Xaa$_3$-Xaa$_1$-Thr-Xaa$_2$-Ile-Xaa$_4$-Ile-Ser-Asn-Gln- (SEQ ID NO:322)
[linker]-Leu-Lys-Ala-Val-Ser-Lys-Glu-Met-Ser-Lys-Arg-Ser-Pro-(OH)NH$_2$ b161) RNH-Val-Pro-Leu-Ser-Arg-Thr-Val-Arg-Cys-Thr-Cys-Ile-Ser-Xaa$_4$-Ser-Asn-Gln- (SEQ ID NO:323)
[linker]-Leu-Lys-Ala-Val-Ser-Lys-Glu-Met-Ser-Lys-Arg-Ser-Pro-(OH)NH$_2$ b162) RNH-Xaa$_3$-Pro-Leu-Ser-Arg-Thr-Val-Arg-Xaa$_1$-Thr-Xaa$_2$-Ile-Ser-Xaa$_4$-Ser-Asn-Gln- (SEQ ID NO:324)
[linker]-Leu-Lys-Ala-Val-Ser-Lys-Glu-Met-Ser-Lys-Arg-Ser-Pro-(OH)NH$_2$ b163) RNH-Val-Xaa$_3$-Leu-Ser-Arg-Thr-Val-Arg-Xaa$_1$-Thr-Xaa$_2$-Ile-Ser-Xaa$_4$-Ser-Asn-Gln- (SEQ ID NO:325)
[linker]-Leu-Lys-Ala-Val-Ser-Lys-Glu-Met-Ser-Lys-Arg-Ser-Pro-(OH)NH$_2$ b164) RNH-Val-Pro-Xaa$_3$-Ser-Arg-Thr-Val-Arg-Xaa$_1$-Thr-Xaa$_2$-Ile-Ser-Xaa$_4$-Ser-Asn-Gln- (SEQ ID NO:326)
[linker]-Leu-Lys-Ala-Val-Ser-Lys-Glu-Met-Ser-Lys-Arg-Ser-Pro-(OH)NH$_2$ b165) RNH-Val-Pro-Leu-Xaa$_3$-Arg-Thr-Val-Arg-Xaa$_1$-Thr-Xaa$_2$-Ile-Ser-Xaa$_4$-Ser-Asn-Gln- (SEQ ID NO:327)
[linker]-Leu-Lys-Ala-Val-Ser-Lys-Glu-Met-Ser-Lys-Arg-Ser-Pro-(OH)NH$_2$ b166) RNH-Val-Pro-Leu-Ser-Xaa$_3$-Thr-Val-Arg-Xaa$_1$-Thr-Xaa$_2$-Ile-Ser-Xaa$_4$-Ser-Asn-Gln- (SEQ ID NO:328)
[linker]-Leu-Lys-Ala-Val-Ser-Lys-Glu-Met-Ser-Lys-Arg-Ser-Pro-(OH)NH$_2$ b167) RNH-Val-Pro-Leu-Ser-Arg-Xaa$_3$-Val-Arg-Xaa$_1$-Thr-Xaa$_2$-Ile-Ser-Xaa$_4$-Ser-Asn-Gln- (SEQ ID NO:329)
[linker]-Leu-Lys-Ala-Val-Ser-Lys-Glu-Met-Ser-Lys-Arg-Ser-Pro-(OH)NH$_2$ b168) RNH-Val-Pro-Leu-Ser-Arg-Thr-Xaa$_3$-Arg-Xaa$_1$-Thr-Xaa$_2$-Ile-Ser-Xaa$_4$-Ser-Asn-Gln- (SEQ ID NO:330)
[linker]-Leu-Lys-Ala-Val-Ser-Lys-Glu-Met-Ser-Lys-Arg-Ser-Pro-(OH)NH$_2$ b169) RNH-Val-Pro-Leu-Ser-Arg-Thr-Val-Xaa$_3$-Xaa$_1$-Thr-Xaa$_2$-Ile-Ser-Xaa$_4$-Ser-Asn-Gln- (SEQ ID NO:331)
[linker]-Leu-Lys-Ala-Val-Ser-Lys-Glu-Met-Ser-Lys-Arg-Ser-Pro-(OH)NH$_2$ b170) RNH-Val-Pro-Leu-Ser-Arg-Thr-Val-Arg-Cys-Thr-Cys-Ile-Ser-Ile-Ser-Xaa$_4$-Gln- (SEQ ID NO:332)
[linker]-Leu-Lys-Ala-Val-Ser-Lys-Glu-Met-Ser-Lys-Arg-Ser-Pro-(OH)NH$_2$ b171) RNH-Xaa$_3$-Pro-Leu-Ser-Arg-Thr-Val-Arg-Xaa$_1$-Thr-Xaa$_2$-Ile-Ser-Ile-Ser-Xaa$_4$-Gln- (SEQ ID NO:333)
[linker]-Leu-Lys-Ala-Val-Ser-Lys-Glu-Met-Ser-Lys-Arg-Ser-Pro-(OH)NH$_2$ b172) RNH-Val-Xaa$_3$-Leu-Ser-Arg-Thr-Val-Arg-Xaa$_1$-Thr-Xaa$_2$-Ile-Ser-Ile-Ser-Xaa$_1$-Gln- (SEQ ID NO:334)
[linker]-Leu-Lys-Ala-Val-Ser-Lys-Glu-Met-Ser-Lys-Arg-Ser-Pro-(OH)NH$_2$ b173) RNH-Val-Pro-Xaa$_3$-Ser-Arg-Thr-Val-Arg-Xaa$_1$-Thr-Xaa$_2$-Ile-Ser-Ile-Ser-Xaa$_4$-Gln- (SEQ ID NO:335)
[linker]-Leu-Lys-Ala-Val-Ser-Lys-Glu-Met-Ser-Lys-Arg-Ser-Pro-(OH)NH$_2$ b174) RNH-Val-Pro-Leu-Xaa$_3$-Arg-Thr-Val-Arg-Xaa$_1$-Thr-Xaa$_2$-Ile-Ser-Ile-Ser-Xaa$_4$-Gln- (SEQ ID NO:336)
[linker]-Leu-Lys-Ala-Val-Ser-Lys-Glu-Met-Ser-Lys-Arg-Ser-Pro-(OH)NH$_2$ b175) RNH-Val-Pro-Leu-Ser-Xaa$_3$-Thr-Val-Arg-Xaa$_1$-Thr-Xaa$_2$-Ile-Ser-Ile-Ser-Xaa$_4$-Gln- (SEQ ID NO:337)
[linker]-Leu-Lys-Ala-Val-Ser-Lys-Glu-Met-Ser-Lys-Arg-Ser-Pro-(OH)NH$_2$ b176) RNH-Val-Pro-Leu-Ser-Arg-Xaa$_3$-Val-Arg-Xaa$_1$-Thr-Xaa$_2$-Ile-Ser-Ile-Ser-Xaa$_4$-Gln- (SEQ ID NO:338)
[linker]-Leu-Lys-Ala-Val-Ser-Lys-Glu-Met-Ser-Lys-Mg-Ser-Pro-(OH)NH$_2$ b177) RNH-Val-Pro-Leu-Ser-Arg-Thr-Xaa$_3$-Arg-Xaa$_1$-Thr-Xaa$_2$-Ile-Ser-Ile-Ser-Xaa$_4$-Gln- (SEQ ID NO:339)
[linker]-Leu-Lys-Ala-Val-Ser-Lys-Glu-Met-Ser-Lys-Arg-Ser-Pro-(OH)NH$_2$ b178) RNH-Val-Pro-Leu-Ser-Arg-Thr-Val-Xaa$_3$-Xaa$_1$-Thr-Xaa$_2$-Ile-Ser-Ile-Ser-Xaa$_4$-Gln- (SEQ ID NO:340)
[linker]-Leu-Lys-Ala-Val-Ser-Lys-Glu-Met-Ser-Lys-Arg-Ser-Pro-(OH)NH$_2$ b170e) RNH-Val-Pro-Leu-Ser-Arg-Thr-Val-Arg-Cys-Thr-Cys-Ile-Ser-Ile-Ser-Gln-Xaa$_4$- (SEQ ID NO:341)
[linker]-Leu-Lys-Ala-Val-Ser-Lys-Glu-Met-Ser-Lys-Arg-Ser-Pro-(OH)NH$_2$ b171e) RNH-Xaa$_3$-Pro-Leu-Ser-Arg-Thr-Val-ArgXaa$_1$-Thr-Xaa$_2$-Ile-Ser-Ile-Ser-Gln-Xaa$_4$- (SEQ ID NO:342)
[linker]-Leu-Lys-Ala-Val-Ser-Lys-Glu-Met-Ser-Lys-Arg-Ser-Pro-(OH)NH$_2$ b172e) RNH-Val-Xaa$_3$-Leu-Ser-Arg-Thr-Val-Arg-Xaa$_1$-Thr-Xaa$_2$-Ile-Ser-Ile-Ser-Gln-Xaa$_4$- (SEQ ID NO:343)
[linker]-Leu-Lys-Ala-Val-Ser-Lys-Glu-Met-Ser-Lys-Arg-Ser-Pro-(OH)NH$_2$ b173e) RNH-Val-Pro-Xaa$_3$-Ser-Arg-Thr-Val-Arg-Xaa$_1$-Thr-Xaa$_2$-Ile-Ser-Ile-Ser-Gln-Xaa$_4$- (SEQ ID NO:344)
[linker]-Leu-Lys-Ala-Val-Ser-Lys-Glu-Met-Ser-Lys-Arg-Ser-Pro-(OH)NH$_2$ -continued b174e) RNH-Val-Pro-Leu-Xaa₃-Arg-Thr-Val-Arg-Xaa₁-Thr-Xaa₂-Ile-Ser-Ile-Ser-Gln-Xaa₁- (SEQ ID NO:345)
       [linker]-Leu-Lys-Ala-Val-Ser-Lys-Glu-Met-Ser-Lys-Arg-Ser-Pro-(OH)NH₂ b175e) RNH-Val-Pro-Leu-Ser-Xaa₃-Thr-Val-Arg-Xaa₁-Thr-Xaa₂-Ile-Ser-Ile-Ser-Gln-Xaa₄- (SEQ ID NO:346)
       [linker]-Leu-Lys-Ala-Val-Ser-Lys-Glu-Met-Ser-Lys-Arg-Ser-Pro-(OH)NH₂ b176e) RNH-Val-Pro-Leu-Ser-Arg-Xaa₃-Val-Arg-Xaa₁-Thr-Xaa₂-Ile-Ser-Ile-Ser-Gln-Xaa₄- (SEQ ID NO:347)
       [linker]-Leu-Lys-Ala-Val-Ser-Lys-Glu-Met-Ser-Lys-Arg-Ser-Pro-(OH)NH₂ b177e) RNH-Val-Pro-Leu-Ser-Arg-Thr-Xaa₃-Arg-Xaa₁-Thr-Xaa₂-Ile-Ser-Ile-Ser-Gln-Xaa₄- (SEQ ID NO:348)
       [linker]-Leu-Lys-Ala-Val-Ser-Lys-Glu-Met-Ser-Lys-Arg-Ser-Pro-(OH)NH₂ b178e) RNH-Val-Pro-Leu-Ser-Arg-Thr-Val-Xaa₃-Xaa₁-Thr-Xaa₂-Ile-Ser-Ile-Ser-Gln-Xaa₁- (SEQ ID NO:349)
       [linker]-Leu-Lys-Ala-Val-Ser-Lys-Glu-Met-Ser-Lys-Arg-Ser-Pro-(OH)NH₂

IP-10-(1-17)-[linker]-IP-10-(54-66)-acid or amide
b179)  RNH-Val-Pro-Leu-Ser-Arg-Thr-Val-Arg-Cys-Thr-Cys-Ile-Ser-Ile-Ser-Asn-Gln- (SEQ ID NO:350)
       [linker]-Leu-Asn-Pro-Glu-Ser-Lys-Ala-Ile-Lys-Asn-Leu-Leu-Lys-(OH)NH₂ b180)  RNH-Xaa₃-Pro-Leu-Ser-Arg-Thr-Val-Arg-Xaa₁-Thr-Xaa₂-Ile-Ser-Ile-Ser-Asn-Gln- (SEQ ID NO:351)
       [linker]-Leu-Asn-Pro-Glu-Ser-Lys-Ala-Ile-Lys-Asn-Leu-Leu-Lys-(OH)NH₂ b181)  RNH-Val-Xaa₃-Leu-Ser-Arg-Thr-Val-Arg-Xaa₁-Thr-Xaa₂-Ile-Ser-Ile-Ser-Asn-Gln- (SEQ ID NO:352)
       [linker]-Leu-Asn-Pro-Glu-Ser-Lys-Ala-Ile-Lys-Asn-Leu-Leu-Lys-(OH)NH₂ b182)  RNH-Val-Pro-Xaa₃-Ser-Arg-Thr-Val-Arg-Xaa₁-Thr-Xaa₂-Ile-Ser-Ile-Ser-Asn-Gln- (SEQ ID NO:353)
       [linker]-Leu-Asn-Pro-Glu-Ser-Lys-Ala-Ile-Lys-Asn-Leu-Leu-Lys-(OH)NH₂ b183)  RNH-Val-Pro-Leu-Xaa₃-Arg-Thr-Val-Arg-Xaa₁-Thr-Xaa₂-Ile-Ser-Ile-Ser-Asn-Gln- (SEQ ID NO:354)
       [linker]-Leu-Asn-Pro-Glu-Ser-Lys-Ala-Ile-Lys-Asn-Leu-Leu-Lys-(OH)NH₂ b184)  RNH-Val-Pro-Leu-Ser-Xaa₃-Thr-Val-Arg-Xaa₁-Thr-Xaa₂-Ile-Ser-Ile-Ser-Asn-Gln- (SEQ ID NO:355)
       [linker]-Leu-Asn-Pro-Glu-Ser-Lys-Ala-Ile-Lys-Asn-Leu-Leu-Lys-(OH)NH₂ b185)  RNH-Val-Pro-Leu-Ser-Arg-Xaa₃-Val-Arg-Xaa₁-Thr-Xaa₂-Ile-Ser-Ile-Ser-Asn-Gln- (SEQ ID NO:356)
       [linker]-Leu-Asn-Pro-Glu-Ser-Lys-Ala-Ile-Lys-Asn-Leu-Leu-Lys-(OH)NH₂ b186)  RNH-Val-Pro-Leu-Ser-Arg-Thr-Xaa₃-Arg-Xaa₁-Thr-Xaa₂-Ile-Ser-Ile-Ser-Asn-Gln- (SEQ ID NO:357)
       [linker]-Leu-Asn-Pro-Glu-Ser-Lys-Ala-Ile-Lys-Asn-Leu-Leu-Lys-(OH)NH₂ b187)  RNH-Val-Pro-Leu-Ser-Arg-Thr-Val-Xaa₃-Xaa₁-Thr-Xaa₂-Ile-Ser-Ile-Ser-Asn-Gln- (SEQ ID NO:358)
       [linker]-Leu-Asn-Pro-Glu-Ser-Lys-Ala-Ile-Lys-Asn-Leu-Leu-Lys-(OH)NH₂ b188)  RNH-Val-Pro-Leu-Ser-Arg-Thr-Val-Arg-Cys-Thr-Cys-Xaa₄-Ser-Ile-Ser-Asn-Gln- (SEQ ID NO:359)
       [linker]-Leu-Asn-Pro-Glu-Ser-Lys-Ala-Ile-Lys-Asn-Leu-Leu-Lys-(OH)NH₂ b189)  RNH-Xaa₃-Pro-Leu-Ser-Arg-Thr-Val-Arg-Xaa₁-Thr-Xaa₂-Xaa₄-Ser-Ile-Ser-Asn-Gln- (SEQ ID NO:360)
       [linker]-Leu-Asn-Pro-Glu-Ser-Lys-Ala-Ile-Lys-Asn-Leu-Leu-Lys(OH)NH₂ b190)  RNH-Val-Xaa₃-Leu-Ser-Arg-Thr-Val-Arg-Xaa₁-Thr-Xaa₂-Xaa₄-Ser-Ile-Ser-Asn-Gln- (SEQ ID NO:361)
       [linker]-Leu-Asn-Pro-Glu-Ser-Lys-Ala-Ile-Lys-Asn-Leu-Leu-Lys-(OH)NH₂ b191)  RNH-Val-Pro-Xaa₃-Ser-Arg-Thr-Val-Arg-Xaa₁-Thr-Xaa₂-Xaa₄-Ser-Ile-Ser-Asn-Gln- (SEQ ID NO:362)
       [linker]-Leu-Asn-Pro-Glu-Ser-Lys-Ala-Ile-Lys-Asn-Leu-Leu-Lys-(OH)NH₂ b192)  RNH-Val-Pro-Leu-Xaa₃-Arg-Thr-Val-Arg-Xaa₁-Thr-Xaa₂-Xaa₄-Ser-Ile-Ser-Asn-Gln- (SEQ ID NO:363)
       [linker]-Leu-Asn-Pro-Glu-Ser-Lys-Ala-Ile-Lys-Asn-Leu-Leu-Lys-(OH)NH₂ b193)  RNH-Val-Pro-Leu-Ser-Xaa₃-Thr-Val-Arg-Xaa₁-Thr-Xaa₂-Xaa₄-Ser-Ile-Ser-Asn-Gln- (SEQ ID NO:364)
       [linker]-Leu-Asn-Pro-Glu-Ser-Lys-Ala-Ile-Lys-Asn-Leu-Leu-Lys-(OH)NH₂ b194)  RNH-Val-Pro-Leu-Ser-Arg-Xaa₃-Val-Arg-Xaa₁-Thr-Xaa₂-Xaa₄-Ser-Ile-Ser-Asn-Gln- (SEQ ID NO:365)
       [linker]-Leu-Asn-Pro-Glu-Ser-Lys-Ala-Ile-Lys-Asn-Leu-Leu-Lys-(OH)NH₂ b195)  RNH-Val-Pro-Leu-Ser-Arg-Thr-Xaa₃-Arg-Xaa₁-Thr-Xaa₂-Xaa₄-Ser-Ile-Ser-Asn-Gln- (SEQ ID NO:366)
       [linker]-Leu-Asn-Pro-Glu-Ser-Lys-Ala-Ile-Lys-Asn-Leu-Leu-Lys-(OH)NH₂ b196)  RNH-Val-Pro-Leu-Ser-Arg-Thr-Val-Xaa₃-Xaa₁-Thr-Xaa₂-Xaa₄-Ser-Ile-Ser-Asn-Gln- (SEQ ID NO:367)
       [linker]-Leu-Asn-Pro-Glu-Ser-Lys-Ala-Ile-Lys-Asn-Leu-Leu-Lys-(OH)NH₂ b197)  RNH-Val-Pro-Leu-Ser-Arg-Thr-Val-Arg-Cys-Thr-Cys-Ile-Xaa₄-Ile-Ser-Asn-Gln- (SEQ ID NO:368)
       [linker]-Leu-Asn-Pro-Glu-Ser-Lys-Ala-Ile-Lys-Asn-Leu-Leu-Lys-(OH)NH₂ b198)  RNH-Xaa₃-Pro-Leu-Ser-Arg-Thr-Val-Arg-Xaa₁-Thr-Xaa₂-Ile-Xaa₄-Ile-Ser-Asn-Gln- (SEQ ID NO:369)
       [linker]-Leu-Asn-Pro-Glu-Ser-Lys-Ala-Ile-Lys-Asn-Leu-Leu-Lys-(OH)NH₂ b199)  RNH-Val-Xaa₃-Leu-Ser-Arg-Thr-Val-Arg-Xaa₁-Thr-Xaa₂-Ile-Xaa₄-Ile-Ser-Asn-Gln- (SEQ ID NO:370)
       [linker]-Leu-Asn-Pro-Glu-Ser-Lys-Ala-Ile-Lys-Asn-Leu-Leu-Lys-(OH)NH₂

-continued b200) RNH-Val-Pro-Xaa₃-Ser-Arg-Thr-Val-Arg-Xaa₁-Thr-Xaa₂-Ile-Xaa₄-Ile-Ser-Asn-Gln-  (SEQ ID NO:371)
     [linker]-Leu-Asn-Pro-Glu-Ser-Lys-Ala-Ile-Lys-Asn-Leu-Leu-Lys-(OH)NH₂ b201) RNH-Val-Pro-Leu-Xaa₃-Arg-Thr-Val-Arg-Xaa₁-Thr-Xaa₂-Ile-Xaa-Ile-Ser-Asn-Gln-  (SEQ ID NO:372)
     [linker]-Leu-Asn-Pro-Glu-Ser-Lys-Ala-Ile-Lys-Asn-Leu-Leu-Lys-(OH)NH₂ b202) RNH-Val-Pro-Leu-Ser-Xaa₃-Thr-Val-Arg-Xaa₁-Thr-Xaa₂-Ile-Xaa₄-Ile-Ser-Asn-Gln-  (SEQ ID NO:373)
     [linker]-Leu-Asn-Pro-Glu-Ser-Lys-Ala-Ile-Lys-Asn-Leu-Leu-Lys-(OH)NH₂ b203) RNH-Val-Pro-Leu-Ser-Arg-Xaa₃-Val-Arg-Xaa₁-Thr-Xaa₂-Ile-Xaa₄-Ile-Ser-Asn-Gln-  (SEQ ID NO:374)
     [linker]-Leu-Asn-Pro-Glu-Ser-Lys-Ala-Ile-Lys-Asn-Leu-Leu-Lys-(OH)NH₂ b204) RNH-Val-Pro-Leu-Ser-Arg-Thr-Xaa₃-Arg-Xaa₁-Thr-Xaa₂-Ile-Xaa₄-Ile-Ser-Asn-Gln-  (SEQ ID NO:375)
     [linker]-Leu-Asn-Pro-Glu-Ser-Lys-Ala-Ile-Lys-Asn-Leu-Leu-Lys-(OH)NH₂ b205) RNH-Val-Pro-Leu-Ser-Arg-Thr-Val-Xaa₃-Xaa₁-Thr-Xaa₂-Ile-Xaa₄-Ile-Ser-Asn-Gln-  (SEQ ID NO:376)
     [linker]-Leu-Asn-Pro-Glu-Ser-Lys-Ala-Ile-Lys-Asn-Leu-Leu-Lys-(OH)NH₂ b206) RNH-Val-Pro-Leu-Ser-Arg-Thr-Val-Arg-Cys-Thr-Cys-Ile-Ser-Xaa₄-Ser-Asn-Gln-  (SEQ ID NO:377)
     [linker]-Leu-Asn-Pro-Glu-Ser-Lys-Ala-Ile-Lys-Asn-Leu-Leu-Lys-(OH)NH₂ b207) RNH-Xaa₃-Pro-Leu-Ser-Arg-Thr-Val-Arg-Xaa₁-Thr-Xaa₂-Ile-Ser-Xaa₄-Ser-Asn-Gln-  (SEQ ID NO:378)
     [linker]-Leu-Asn-Pro-Glu-Ser-Lys-Ala-Ile-Lys-Asn-Leu-Leu-Lys-(OH)NH₂ b208) RNH-Val-Xaa₃-Leu-Ser-Arg-Thr-Val-Arg-Xaa₁-Thr-Xaa₂-Ile-Ser-Xaa-Ser-Asn-Gln-  (SEQ ID NO:379)
     [linker]-Leu-Asn-Pro-Glu-Ser-Lys-Ala-Ile-Lys-Asn-Leu-Leu-Lys-(OH)NH₂ b209) RNH-Val-Pro-Xaa₃-Ser-Arg-Thr-Val-Arg-Xaa₁-Thr-Xaa₂-Ile-Ser-Xaa₄-Ser-Asn-Gln-  (SEQ ID NO:380)
     [linker]-Leu-Asn-Pro-Glu-Ser-Lys-Ala-Ile-Lys-Asn-Leu-Leu-Lys-(OH)NH₂ b210) RNH-Val-Pro-Leu-Xaa₃-Arg-Thr-Val-Arg-Xaa₁-Thr-Xaa₂-Ile-Ser-Xaa₄-Ser-Asn-Gln-  (SEQ ID NO:381)
     [linker]-Leu-Asn-Pro-Glu-Ser-Lys-Ala-Ile-Lys-Asn-Leu-Leu-Lys-(OH)NH₂ b211) RNH-Val-Pro-Leu-Ser-Xaa₃-Thr-Val-Arg-Xaa₁-Thr-Xaa₂-Ile-Ser-Xaa₄-Ser-Asn-Gln-  (SEQ ID NO:382)
     [linker]-Leu-Asn-Pro-Glu-Ser-Lys-Ala-Ile-Lys-Asn-Leu-Leu-Lys-(OH)NH₂ b212) RNH-Val-Pro-Leu-Ser-Arg-Xaa₃-Val-Arg-Xaa₁-Thr-Xaa₂-Ile-Ser-Xaa-Ser-Asn-Gln-  (SEQ ID NO:383)
     [linker]-Leu-Asn-Pro-Gln-Ser-Lys-Ala-Ile-Lys-Asn-Leu-Leu-Lys-(OH)NH₂ b213) RNH-Val-Pro-Leu-Ser-Arg-Thr-Xaa₃-Arg-Xaa₁-Thr-Xaa₂-Ile-Ser-Xaa₄-Ser-Asn-Gln-  (SEQ ID NO:384)
     [linker]-Leu-Asn-Pro-Glu-Ser-Lys-Ala-Ile-Lys-Asn-Leu-Leu-Lys-(OH)-NH₂ b214) RNH-Val-Pro-Leu-Ser-Arg-Thr-Val-Xaa₃-Xaa₁-Thr-Xaa₂-Ile-Ser-Xaa₄-Ser-Asn-Gln-  (SEQ ID NO:385)
     [linker]-Leu-Asn-Pro-Glu-Ser-Lys-Ala-Ile-Lys-Asn-Leu-Leu-Lys-(OH)-₂ b215) RNH-Val-Pro-Leu-Ser-Arg-Thr-Val-Arg-Cys-Thr-Cys-Ile-Ser-Ile-Ser-Xaa₄-Gln-  (SEQ ID NO:386)
     [linker]-Leu-Asn-Pro-Glu-Ser-Lys-Ala-Ile-Lys-Asn-Leu-Leu-Lys-(OH)NH₂ b216) RNH-Xaa₃-Pro-Leu-Ser-Arg-Thr-Val-Arg-Xaa₁-Thr-Xaa₂-Ile-Ser-Ile-Ser-Xaa-Gln-  (SEQ ID NO:387)
     [linker]-Leu-Asn-Pro-Glu-Ser-Lys-Ala-Ile-Lys-Asn-Leu-Leu-Lys-(OH)NH₂ b217) RNH-Val-Xaa₃-Leu-Ser-Arg-Thr-Val-Arg-Xaa₁-Thr-Xaa₂-Ile-Ser-Ile-Ser-Xaa₄-Glu-  (SEQ ID NO:388)
     [linker]-Leu-Asn-Pro-Glu-Ser-Lys-Ala-Ile-Lys-Asn-Leu-Leu-Lys-(OH)NH₂ b218) RNH-Val-Pro-Xaa₃-Ser-Arg-Thr-Val-Arg-Xaa₁-Thr-Xaa₂-Ile-Ser-Ile-Ser-Xaa₄-Gln-  (SEQ ID NO:389)
     [linker]-Leu-Asn-Pro-Glu-Ser-Lys-Ala-Ile-Lys-Asn-Leu-Leu-Lys-(OH)NH₂ b219) RNH-Val-Pro-Leu-Xaa₃-Arg-Thr-Val-Arg-Xaa₁-Thr-Xaa₂-Ile-Ser-Ile-Ser-Xaa₄-Gln-  (SEQ ID NO:390)
     [linker]-Leu-Asn-Pro-Glu-Ser-Lys-Ala-Ile-Lys-Asn-Leu-Leu-Lys-(OH)NH₂ b220) RNH-Val-Pro-Leu-Ser-Xaa₃-Thr-Val-Arg-Xaa₁-Thr-Xaa₂-Ile-Ser-Ile-Ser-Xaa₄-Gln-  (SEQ ID NO:391)
     [linker]-Leu-Asn-Pro-Glu-Ser-Lys-Ala-Ile-Lys-Asn-Leu-Leu-Lys-(OH)NH₂ b221) RNH-Val-Pro-Leu-Ser-Arg-Xaa₃-Val-Arg-Xaa₁-Thr-Xaa₂-Ile-Ser-Ile-Ser-Xaa₄-Gln-  (SEQ ID NO:392)
     [linker]-Leu-Asn-Pro-Glu-Ser-Lys-Ala-Ile-Lys-Asn-Leu-Leu-Lys-(OH)NH₂ b222) RNH-Val-Pro-Leu-Ser-Arg-Thr-Xaa₃-Arg-Xaa₁-Thr-Xaa₂-Ile-Ser-Ile-Ser-Xaa₄-Gln-  (SEQ ID NO:393)
     [linker]-Leu-Asn-Pro-Glu-Ser-Lys-Ala-Ile-Lys-Asn-Leu-Leu-Lys-(OH)NH₂ b223) RNH-Val-Pro-Leu-Ser-Arg-Thr-Val-Xaa₃-Xaa₁-Thr-Xaa₂-Ile-Ser-Ile-Ser-Xaa₄-Gln-  (SEQ ID NO:394)
     [linker]-Leu-Asn-Pro-Glu-Ser-Lys-Ala-Ile-Lys-Asn-Leu-Leu-Lys-(OH)NH₂ b224) RNH-Val-Pro-Leu-Ser-Arg-Xaa₃-Arg-Xaa₁-Thr-Xaa₂-Ile-Ser-Ile-Ser-Xaa₄-Gln-  (SEQ ID NO:395)
     [linker]-Leu-Asn-Pro-Glu-Ser-Lys-Ala-Ile-Lys-Asn-Leu-Leu-Lys-(OH)NH₂ b225) RNH-Xaa₃-Pro-Leu-Ser-Arg-Thr-Val-Arg-Xaa₁-Thr-Xaa₂-Ile-Ser-Ile-Ser-Gln-Xaa₄-  (SEQ ID NO:396)
     [linker]-Leu-Asn-Pro-Glu-Ser-Lys-Ala-Ile-Lys-Asn-Leu-Leu-Lys-(OH)NH₂ b226) RNH-Val-Xaa₃-Leu-Ser-Arg-Thr-Val-Arg-Xaa₁-Thr-Xaa₂-Ile-Ser-Ile-Ser-Gln-Xaa₄-  (SEQ ID NO:397)
     [linker]-Leu-Asn-Pro-Glu-Ser-Lys-Ala-Ile-Lys-Asn-Leu-Leu-Lys-(OH)NH₂

-continued b227) RNH-Val-Pro-Xaa₃-Ser-Arg-Thr-Val-Arg-Xaa₁-Thr-Xaa₂-Ile-Ser-Ile-Ser-Gln-Xaa₄- (SEQ ID NO:398)
[linker]-Leu-Asn-Pro-Glu-Ser-Lys-Ala-Ile-Lys-Asn-Leu-Leu-Lys-(OH)NH₂ b228) RNH-Val-Pro-Leu-Xaa₃-Arg-Thr-Val-Arg-Xaa₁-Thr-Xaa₂-Ile-Ser-Ile-Ser-Gln-Xaa₄- (SEQ ID NO:399)
[linker]-Leu-Asn-Pro-Glu-Ser-Lys-Ala-Ile-Lys-Asn-Leu-Leu-Lys-(OH)NH₂ b229) RNH-Val-Pro-Leu-Ser-Xaa₃-Thr-Val-Arg-Xaa₁-Thr-Xaa₂-Ile-Ser-Ile-Ser-Gln-Xaa₄- (SEQ ID NO:400)
[linker]-Leu-Asn-Pro-Glu-Ser-Lys-Ala-Ile-Lys-Asn-Leu-Leu-Lys(OH)NH₂ b230) RNH-Val-Pro-Leu-Ser-Arg-Xaa₃-Val-Arg-Xaa₁-Thr-Xaa₂-Ile-Ser-Ile-Ser-Gln-Xaa₄- (SEQ ID NO:401)
[linker]-Leu-Asn-Pro-Glu-Ser-Lys-Ala-Ile-Lys-Asn-Leu-Leu-Lys-(OH)NH₂ b231) RNH-Val-Pro-Leu-Ser-Arg-Thr-Xaa₃-Arg-Xaa₁-Thr-Xaa₂-Ile-Ser-Ile-Ser-Gln-Xaa₄- (SEQ ID NO:402)
[linker]-Leu-Asn-Pro-Glu-Ser-Lys-Ala-Ile-Lys-Asn-Leu-Leu-Lys-(OH)NH₂ b232) RNH-Val-Pro-Leu-Ser-Arg-Thr-Val-Xaa₃-Xaa₁-Thr-Xaa₂-Ile-Ser-Ile-Ser-Gln-Xaa₄- (SEQ ID NO:403)
[linker]-Leu-Asn-Pro-Glu-Ser-Lys-Ala-Ile-Lys-Asn-Leu-Leu-Lys-(OH)NH₂

IP-10-(1-17)-[linker]-IP-10-(59-71)-acid or amide b233) RNH-Val-Pro-Leu-Ser-Arg-Thr-Val-Arg-Cys-Thr-Cys-Ile-Ser-Ile-Ser-Asn-Gln- (SEQ ID NO:404)
[linker]-Lys-Ala-Ile-Lys-Asn-Leu-Leu-Lys-Ala-Val-Ser-Lys-Glu-(OH)NH₂ b234) RNH-Xaa₃-Pro-Leu-Ser-Arg-Thr-Val-Arg-Xaa₁-Thr-Xaa₂-Ile-Ser-Ile-Ser-Asn-Gln- (SEQ ID NO:405)
[linker]-Lys-Ala-Ile-Lys-Asn-Leu-Leu-Lys-Ala-Val-Ser-Lys-Glu-(OH)NH₂ b235) RNH-Val-Xaa₃-Leu-Ser-Arg-Thr-Val-Arg-Xaa₁-Thr-Xaa₂-Ile-Ser-Ile-Ser-Asn-Gln- (SEQ ID NO:406)
[linker]-Lys-Ala-Ile-Lys-Asn-Leu-Leu-Lys-Ala-Val-Ser-Lys-Glu-(OH)-NH₂ b236) RNH-Val-Pro-Xaa₃-Ser-Arg-Thr-Val-Arg-Xaa₁-Thr-Xaa₂-Ile-Ser-Ile-Ser-Asn-Gln- (SEQ ID NO:407)
[linker]-Lys-Ala-Ile-Lys-Asn-Leu-Leu-Lys-Ala-Val-Ser-Lys-Glu-(OH)NH₂ b237) RNH-Val-Pro-Leu-Xaa₃-Arg-Thr-Val-Arg-Xaa₁-Thr-Xaa₂-Ile-Ser-Ile-Ser-Asn-Gln- (SEQ ID NO:408)
[linker]-Lys-Ala-Ile-Lys-Asn-Leu-Leu-Lys-Ala-Val-Ser-Lys-Glu-(OH)NH₂ b238) RNH-Val-Pro-Leu-Ser-Xaa₃-Thr-Val-Arg-Xaa₁-Thr-Xaa₂-Ile-Ser-Ile-Ser-Asn-Gln- (SEQ ID NO:409)
[linker]-Lys-Ala-Ile-Lys-Asn-Leu-Leu-Lys-Ala-Val-Ser-Lys-Glu-(OH)NH₂ b239) RNH-Val-Pro-Leu-Ser-Arg-Xaa₃-Val-Arg-Xaa₁-Thr-Xaa₂-Ile-Ser-Ile-Ser-Asn-Gln- (SEQ ID NO:410)
[linker]-Lys-Ala-Ile-Lys-Asn-Leu-Leu-Lys-Ala-Val-Ser-Lys-Glu-(OH)NH₂ b240) RNH-Val-Pro-Leu-Ser-Arg-Thr-Xaa₃-Arg-Xaa₁-Thr-Xaa₂-Ile-Ser-Ile-Ser-Asn-Gln- (SEQ ID NO:411)
[linker]-Lys-Ala-Ile-Lys-Asn-Leu-Leu-Lys-Ala-Val-Ser-Lys-Glu-(OH)NH₂ b241) RNH-Val-Pro-Leu-Ser-Arg-Thr-Val-Xaa₃-Xaa₁-Thr-Xaa₂-Ile-Ser-Ile-Ser-Asn-Gln- (SEQ ID NO:412)
[linker]-Lys-Ala-Ile-Lys-Asn-Leu-Leu-Lys-Ala-Val-Ser-Lys-Glu-(OH)NH₂ b242) RNH-Val-Pro-Leu-Ser-Arg-Thr-Val-Arg-Cys-Thr-Cys-Xaa₄-Ser-Ile-Ser-Asn-Gln- (SEQ ID NO:413)
[linker]-Lys-Ala-Ile-Lys-Asn-Leu-Leu-Lys-Ala-Val-Ser-Lys-Glu-(OH)NH₂ b243) RNH-Xaa₃-Pro-Leu-Ser-Arg-Thr-Val-Arg-Xaa₁-Thr-Xaa₂-Xaa₄-Ser-Ile-Ser-Asn-Gln- (SEQ ID NO:414)
[linker]-Lys-Ala-Ile-Lys-Asn-Leu-Leu-Lys-Ala-Val-Ser-Lys-Glu-(OH)NH₂ b244) RNH-Val-Xaa₃-Leu-Ser-Arg-Thr-Val-Arg-Xaa₁-Thr-Xaa₂-Xaa₄-Ser-Ile-Ser-Asn-Gln- (SEQ ID NO:415)
[linker]-Lys-Ala-Ile-Lys-Asn-Leu-Leu-Lys-Ala-Val-Ser-Lys-Glu-(OH)NH₂ b245) RNH-Val-Pro-Xaa₃-Ser-Arg-Thr-Val-Arg-Xaa₁-Thr-Xaa₂-Xaa₄-Ser-Ile-Ser-Asn-Gln- (SEQ ID NO:416)
[linker]-Lys-Ala-Ile-Lys-Asn-Leu-Leu-Lys-Ala-Val-Ser-Lys-Glu-(OH)NH₂ b246) RNH-Val-Pro-Leu-Xaa₃-Arg-Thr-Val-Arg-Xaa₁-Thr-Xaa₂-Xaa₄-Ser-Ile-Ser-Asn-Gln- (SEQ ID NO:417)
[linker]-Lys-Ala-Ile-Lys-Asn-Leu-Leu-Lys-Ala-Val-Ser-Lys-Glu-(OH)NH₂ b247) RNH-Val-Pro-Leu-Ser-Xaa₃-Thr-Val-Arg-Xaa₁-Thr-Xaa₂-Xaa₄-Ser-Ile-Ser-Asn-Gln- (SEQ ID NO:418)
[linker]-Lys-Ala-Ile-Lys-Asn-Leu-Leu-Lys-Ala-Val-Ser-Lys-Glu-(OH)NH₂ b248) RNH-Val-Pro-Leu-Ser-Arg-Xaa₃-Val-Arg-Xaa₁-Thr-Xaa₂-Xaa₄-Ser-Ile-Ser-Asn-Gln- (SEQ ID NO:419)
[linker]-Lys-Ala-Ile-Lys-Asn-Leu-Leu-Lys-Ala-Val-Ser-Lys-Glu-(OH)NH₂ b249) RNH-Val-Pro-Leu-Ser-Arg-Thr-Xaa₃-Arg-Xaa₁-Thr-Xaa₂-Xaa₄-Ser-Ile-Ser-Asn-Gln- (SEQ ID NO:420)
[linker]-Lys-Ala-Ile-Lys-Asn-Leu-Leu-Lys-Ala-Val-Ser-Lys-Glu-(OH)NH₂ b250) RNH-Val-Pro-Leu-Ser-Arg-Thr-Val-Xaa₃-Xaa₁-Thr-Xaa₂-Xaa₄-Ser-Ile-Ser-Asn-Gln- (SEQ ID NO:421)
[linker]-Lys-Ala-Ile-Lys-Asn-Leu-Leu-Lys-Ala-Val-Ser-Lys-Glu-(OH)NH₂ b251) RNH-Val-Pro-Leu-Ser-Arg-Thr-Val-Arg-Cys-Thr-Cys-Ile-Xaa₄-Ile-Ser-Asn-Gln- (SEQ ID NO:422)
[linker]-Lys-Ala-Ile-Lys-Asn-Leu-Leu-Lys-Ala-Val-Ser-Lys-Glu-(OH)NH₂ b252) RNH-Xaa₃-Pro-Leu-Ser-Arg-Thr-Val-Arg-Xaa₁-Thr-Xaa₂-Ile-Xaa₄-Ile-Ser-Asn-Gln- (SEQ ID NO:423)
[linker]-Lys-Ala-Ile-Lys-Asn-Leu-Leu-Lys-Ala-Val-Ser-Lys-Glu-(OH)NH₂

-continued b253) RNH-Val-Xaa₃-Leu-Ser-Arg-Thr-Val-Arg-Xaa₁-Thr-Xaa₂-Ile-Xaa₄-Ile-Ser-Asn-Gln- (SEQ ID NO:424)
[linker]-Lys-Ala-Ile-Lys-Asn-Leu-Leu-Lys-Ala-Val-Ser-Lys-Glu-(OH)NH₂ b254) RNH-Val-Pro-Xaa₃-Ser-Arg-Thr-Val-Arg-Xaa₁-Thr-Xaa₂-Ile-Xaa₄-Ile-Ser-Asn-Gln- (SEQ ID NO:425)
[linker]-Lys-Ala-Ile-Lys-Asn-Leu-Leu-Lys-Ala-Val-Ser-Lys-Glu-(OH)NH₂ b255) RNH-Val-Pro-Leu-Xaa₃-Arg-Thr-Val-Arg-Xaa₁-Thr-Xaa₂-Ile-Xaa₄-Ile-Ser-Asn-Gln- (SEQ ID NO:426)
[linker]-Lys-Ala-Ile-Lys-Asn-Leu-Leu-Lys-Ala-Val-Ser-Lys-Glu-(OH)NH₂ b256) RNH-Val-Pro-Leu-Ser-Xaa₃-Thr-Val-Arg-Xaa₁-Thr-Xaa₂-Ile-Xaa₄-Ile-Ser-Asn-Gln- (SEQ ID NO:427)
[linker]-Lys-Ala-Ile-Lys-Asn-Leu-Leu-Lys-Ala-Val-Ser-Lys-Glu-(OH)NH₂ b257) RNH-Val-Pro-Leu-Ser-Arg-Xaa₃-Val-Arg-Xaa₁-Thr-Xaa₂-Ile-Xaa₁-Ile-Ser-Asn-Gln- (SEQ ID NO:428)
[linker]-Lys-Ala-Ile-Lys-Asn-Leu-Leu-Lys-Ala-Val-Ser-Lys-Glu-(OH)NH₂ b258) RNH-Val-Pro-Leu-Ser-Arg-Thr-Xaa₃-Arg-Xaa₁-Thr-Xaa₂-Ile-Xaa₁-Ile-Ser-Asn-Gln- (SEQ ID NO:429)
[linker]-Lys-Ala-Ile-Lys-Asn-Leu-Leu-Lys-Ala-Val-Ser-Lys-Glu-(OH)NH₂ b259) RNH-Val-Pro-Leu-Ser-Arg-Thr-Val-Xaa₃-Xaa₁-Thr-Xaa₂-Ile-Xaa₄-Ile-Ser-Asn-Gln- (SEQ ID NO:430)
[linker]-Lys-Ala-Ile-Lys-Asn-Leu-Leu-Lys-Ala-Val-Ser-Lys-Glu-(OH)NH₂ b260) RNH-Val-Pro-Leu-Ser-Arg-Thr-Val-Arg-Cys-Thr-Cys-Ile-Ser-Xaa₄-Ser-Asn-Gln- (SEQ ID NO:431)
[linker]-Lys-Ala-Ile-Lys-Asn-Leu-Leu-Lys-Ala-Val-Ser-Lys-Glu-(OH)NH₂ b261) RNH-Xaa₃-Pro-Leu-Ser-Arg-Thr-Val-Arg-Xaa₁-Thr-Xaa₂-Ile-Ser-Xaa₄-Ser-Asn-Gln- (SEQ ID NO:432)
[linker]-Lys-Ala-Ile-Lys-Asn-Leu-Leu-Lys-Ala-Val-Ser-Lys-Glu-(OH)NH₂ b262) RNH-Val-Xaa₃-Leu-Ser-Arg-Thr-Val-Arg-Xaa₁-Thr-Xaa₂-Ile-Ser-Xaa₄-Ser-Asn-Gln- (SEQ ID NO:433)
[linker]-Lys-Ala-Ile-Lys-Asn-Leu-Leu-Lys-Ala-Val-Ser-Lys-Glu-(OH)NH₂ b263) RNH-Val-Pro-Xaa₃-Ser-Arg-Thr-Val-Arg-Xaa₁-Thr-Xaa₂-Ile-Ser-Xaa₁-Ser-Asn-Gln- (SEQ ID NO:434)
[linker]-Lys-Ala-Ile-Lys-Asn-Leu-Leu-Lys-Ala-Val-Ser-Lys-Glu-(OH)NH₂ b264) RNH-Val-Pro-Leu-Xaa₃-Arg-Thr-Val-Arg-Xaa₁-Thr-Xaa₂-Ile-Ser-Xaa₄-Ser-Asn-Gln- (SEQ ID NO:435)
[linker]-Lys-Ala-Ile-Lys-Asn-Leu-Leu-Lys-Ala-Val-Ser-Lys-Glu-(OH)NH₂ b265) RNH-Val-Pro-Leu-Ser-Xaa₃-Thr-Val-Arg-Xaa₁-Thr-Xaa₂-Ile-Ser-Xaa₄-Ser-Asn-Gln- (SEQ ID NO:436)
[linker]-Lys-Ala-Ile-Lys-Asn-Leu-Leu-Lys-Ala-Val-Ser-Lys-Glu-(OH)NH₂ b266) RNH-Val-Pro-Leu-Ser-Arg-Xaa₃-Val-Arg-Xaa₁-Thr-Xaa₂-Ile-Ser-Xaa₄-Ser-Asn-Gln- (SEQ ID NO:437)
[linker]-Lys-Ala-Ile-Lys-Asn-Leu-Leu-Lys-Ala-Val-Ser-Lys-Glu-(OH)NH₂ b267) RNH-Val-Pro-Leu-Ser-Arg-Thr-Xaa₃-Arg-Xaa₁-Thr-Xaa₂-Ile-Ser-Xaa₄-Ser-Asn-Gln- (SEQ ID NO:438)
[linker]-Lys-Ala-Ile-Lys-Asn-Leu-Leu-Lys-Ala-Val-Ser-Lys-Glu-(OH)NH₂ b268) RNH-Val-Pro-Leu-Ser-Arg-Thr-Val-Xaa₃-Xaa₁-Thr-Xaa₂-Ile-Ser-Xaa₄-Ser-Asn-Gln- (SEQ ID NO:439)
[linker]-Lys-Ala-Ile-Lys-Asn-Leu-Leu-Lys-Ala-Val-Ser-Lys-Glu-(OH)NH₂ b269) RNH-Val-Pro-Leu-Ser-Arg-Thr-Val-Arg-Cys-Thr-Cys-Ile-Ser-Ile-Ser-Xaa₄-Gln- (SEQ ID NO:440)
[linker]-Lys-Ala-Ile-Lys-Asn-Leu-Leu-Lys-Ala-Val-Val-Ser-Lys-Glu-(OH)NH₂ b270) RNH-Xaa₃-Pro-Leu-Ser-Arg-Thr-Val-Arg-Xaa₁-Thr-Xaa₂-Ile-Ser-Ile-Ser-Xaa₄-Gln- (SEQ ID NO:441)
[linker]-Lys-Ala-Ile-Lys-Asn-Leu-Leu-Lys-Ala-Val-Ser-Lys-Glu-(OH)NH₂ b271) RNH-Val-Xaa₃-Leu-Ser-Arg-Thr-Val-Arg-Xaa₁-Thr-Xaa₂-Ile-Ser-Ile-Ser-Xaa₄-Gln- (SEQ ID NO:442)
[linker]-Lys-Ala-Ile-Lys-Asn-Leu-Leu-Lys-Ala-Val-Ser-Lys-Glu-(OH)NH₂ b272) RNH-Val-Pro-Xaa₃-Ser-Arg-Thr-Val-Arg-Xaa₁-Thr-Xaa₂-Ile-Ser-Ile-Ser-Xaa₄-Gln- (SEQ ID NO:443)
[linker]-Lys-Ala-Ile-Lys-Asn-Leu-Leu-Lys-Ala-Val-Ser-Lys-Glu-(OH)NH₂ b273) RNH-Val-Pro-Leu-Xaa₃-Arg-Thr-Val-Arg-Xaa₁-Thr-Xaa₂-Ile-Ser-Ile-Ser-Xaa₄-Gln- (SEQ ID NO:444)
[linker]-Lys-Ala-Ile-Lys-Asn-Leu-Leu-Lys-Ala-Val-Ser-Lys-Glu-(OH)NH₂ b274) RNH-Val-Pro-Leu-Ser-Xaa₃-Thr-Val-Arg-Xaa₁-Thr-Xaa₂-Ile-Ser-Ile-Ser-Xaa₄-Gln- (SEQ ID NO:445)
[linker]-Lys-Ala-Ile-Lys-Asn-Leu-Leu-Lys-Ala-Val-Ser-Lys-Glu-(OH)NH₂ b275) RNH-Val-Pro-Leu-Ser-Arg-Xaa₃-Val-Arg-Xaa₁-Thr-Xaa₂-Ile-Ser-Ile-Ser-Xaa₄-Gln- (SEQ ID NO:446)
[linker]-Lys-Ala-Ile-Lys-Asn-Leu-Leu-Lys-Ala-Val-Ser-Lys-Glu-(OH)NH₂ b276) RNH-Val-Pro-Leu-Ser-Arg-Thr-Xaa₃-Arg-Xaa₁-Thr-Xaa₂-Ile-Ser-Ile-Ser-Xaa₄-Gln- (SEQ ID NO:447)
[linker]-Lys-Ala-Ile-Lys-Asn-Leu-Leu-Lys-Ala-Val-Ser-Lys-Glu-(OH)NH₂ b277) RNH-Val-Pro-Leu-Ser-Arg-Thr-Val-Xaa₃-Xaa₁-Thr-Xaa₂-Ile-Ser-Ile-Ser-Xaa₄-Gln- (SEQ ID NO:448)
[linker]-Lys-Ala-Ile-Lys-Asn-Leu-Leu-Lys-Ala-Val-Ser-Lys-Glu-(OH)NH₂ b278) RNH-Val-Pro-Leu-Ser-Arg-Thr-Val-Arg-Cys-Thr-Cys-Ile-Ser-Ile-Ser-Gln-Xaa₄- (SEQ ID NO:449)
[linker]-Lys-Ala-Ile-Lys-Asn-Leu-Leu-Lys-Ala-Val-Ser-Lys-Glu-(OH)NH₂ b279) RNH-Xaa₃-Pro-Leu-Ser-Arg-Thr-Val-Arg-Xaa₁-Thr-Xaa₂-Ile-Ser-Ile-Ser-Gln-Xaa₄- (SEQ ID NO:450)
[linker]-Lys-Ala-Ile-Lys-Asn-Leu-Leu-Lys-Ala-Val-Ser-Lys-Glu-(OH)NH₂

-continued b280) RNH-Val-Xaa$_3$-Leu-Ser-Arg-Thr-Val-Arg-Xaa$_1$-Thr-Xaa$_2$-Ile-Ser-Ile-Ser-Gln-Xaa$_4$- (SEQ ID NO:451)
[linker]-Lys-Ala-Ile-Lys-Asn-Leu-Leu-Lys-Ala-Val-Ser-Lys-Glu-(OH)NH$_2$ b281) RNH-Val-Pro-Xaa$_3$-Ser-Arg-Thr-Val-Arg-Xaa$_1$-Thr-Xaa$_2$-Ile-Ser-Ile-Ser-Gln-Xaa$_4$- (SEQ ID NO:452)
[linker]-Lys-Ala-Ile-Lys-Asn-Leu-Leu-Lys-Ala-Val-Ser-Lys-Glu-(OH)NH$_2$ b282) RNH-Val-Pro-Leu-Xaa$_3$-Arg-Thr-Val-Arg-Xaa$_1$-Thr-Xaa$_2$-Ile-Ser-Ile-Ser-Gln-Xaa$_4$- (SEQ ID NO:453)
[linker]-Lys-Ala-Ile-Lys-Asn-Leu-Leu-Lys-Ala-Val-Ser-Lys-Glu-(OH)NH$_2$ b283) RNH-Val-Pro-Leu-Ser-Xaa$_3$-Thr-Val-Arg-Xaa$_1$-Thr-Xaa$_2$-Ile-Ser-Ile-Ser-Gln-Xaa$_4$- (SEQ ID NO:454)
[linker]-Lys-Ala-Ile-Lys-Asn-Leu-Leu-Lys-Ala-Val-Ser-Lys-Glu-(OH)NH$_2$ b284) RNH-Val-Pro-Leu-Ser-Arg-Xaa$_3$-Val-Arg-Xaa$_1$-Thr-Xaa$_2$-Ile-Ser-Ile-Ser-Gln-Xaa$_4$- (SEQ ID NO:455)
[linker]-Lys-Ala-Ile-Lys-Asn-Leu-Leu-Lys-Ala-Val-Ser-Lys-Glu-(OH)NH$_2$ b285) RNH-Val-Pro-Leu-Ser-Arg-Thr-Xaa$_3$-Arg-Xaa$_1$-Thr-Xaa$_2$-Ile-Ser-Ile-Ser-Gln-Xaa$_4$- (SEQ ID NO:456)
[linker]-Lys-Ala-Ile-Lys-Asn-Leu-Leu-Lys-Ala-Val-Ser-Lys-Glu-(OH)NH$_2$ b286) RNH-Val-Pro-Leu-Ser-Arg-Thr-Val-Xaa$_3$-Xaa$_1$-Thr-Xaa$_2$-Ile-Ser-Ile-Ser-Gln-Xaa$_4$- (SEQ ID NO:457)
[linker]-Lys-Ala-Ile-Lys-Asn-Leu-Leu-Lys-Ala-Val-Ser-Lys-Glu-(OH)NH$_2$ Preferred embodiments of cyclic IP-10 analogs of the present invention corresponding to a portion the N-terminal region joined with a linker to a cyclic portion of the C-terminal region of IP-10 having the following structures (underlined residues are cyclized):

IP-10-(1–14)-[linker]-IP-10-(65–77)-cyclic (Glu71–Lys74) acid or amide b287) RNH-Val-Pro-Leu-Ser-Arg-Thr-Val-Arg-Cys-Thr-Cys-Ile-Ser-Ile-[linker]-Leu-Lys- (SEQ ID NO:458)
Ala-Val-Ser-Lys-Glu-Met-Ser-Lys-Arg-Ser-Pro-(OH)NH$_2$ b288) RNH-Xaa$_3$-Pro-Leu-Ser-Arg-Thr-Val-Arg-Xaa$_1$-Thr-Xaa$_2$-Ile-Ser-Ile-[linker]-Leu- (SEQ ID NO:459)
Lys-Ala-Val-Ser-Lys-Glu-Met-Ser-Lys-Arg-Ser-Pro-(OH)NH$_2$ b289) RNH-Val-Xaa$_3$-Leu-Ser-Arg-Thr-Val-Arg-Xaa$_1$-Thr-Xaa$_2$-Ile-Ser-Ile-[linker]-Leu- (SEQ ID NO:460)
Lys-Ala-Val-Ser-Lys-Glu-Met-Ser-Lys-Arg-Ser-Pro-(OH)NH$_2$ b290) RNH-Val-Pro-Xaa$_3$-Ser-Arg-Thr-Val-Arg-Xaa$_1$-Thr-Xaa$_2$-Ile-Ser-Ile-[linker]-Leu- (SEQ ID NO:461)
Lys-Ala-Val-Ser-Lys-Glu-Met-Ser-Lys-Arg-Ser-Pro-(OH)NH$_2$ b300) RNH-Val-Pro-Leu-Xaa$_3$-Arg-Thr-Val-Arg-Xaa$_1$-Thr-Xaa$_2$-Ile-Ser-Ile-[linker]-Leu- (SEQ ID NO:462)
Lys-Ala-Val-Ser-Lys-Glu-Met-Ser-Lys-Arg-Ser-Pro-(OH)NH$_2$ b301) RNH-Val-Pro-Leu-Ser-Xaa$_3$-Thr-Val-Arg-Xaa$_1$-Thr-Xaa$_2$-Ile-Ser-Ile-[linker]-Leu- (SEQ ID NO:463)
Lys-Ala-Val-Ser-Lys-Glu-Met-Ser-Lys-Arg-Ser-Pro-(OH)NH$_2$ b302) RNH-Val-Pro-Leu-Ser-Arg-Xaa$_3$-Val-Arg-Xaa$_1$-Thr-Xaa$_2$-Ile-Ser-Ile-[linker]-Leu- (SEQ ID NO:464)
Lys-Ala-Val-Ser-Lys-Glu-Met-Ser-Lys-Arg-Ser-Pro-(OH)NH$_2$ b303) RNH-Val-Pro-Leu-Ser-Arg-Thr-Xaa$_3$-Arg-Xaa$_1$-Thr-Xaa$_2$-Ile-Ser-Ile-[linker]-Leu- (SEQ ID NO:465)
Lys-Ala-Val-Ser-Lys-Glu-Met-Ser-Lys-Arg-Ser-Pro-(OH)NH$_2$ b304) RNH-Val-Pro-Leu-Ser-Arg-Thr-Val-Xaa$_3$-Xaa1-Thr-Xaa$_2$-Ile-Ser-Ile-[linker]-Leu- (SEQ ID NO:466)
Lys-Ala-Val-Ser-Lys-Glu-Met-Ser-Lys-Arg-Ser-Pro-(OH)NH$_2$ b305) RNH-Val-Pro-Leu-Ser-Arg-Thr-Val-Arg-Cys-Thr-Cys-Xaa$_4$-Ser-Ile-[linker]-Leu- (SEQ ID NO:467)
Lys-Ala-Val-Ser-Lys-Glu-Met-Ser-Lys-Arg-Ser-Pro-(OH)NH$_2$ b306) RNH-Xaa$_3$-Pro-Leu-Ser-Arg-Thr-Val-Arg-Xaa$_1$-Thr-Xaa$_2$-Xaa$_4$-Ser-Ile-[linker-]-Leu- (SEQ ID NO:468)
Lys-Ala-Val-Ser-Lys-Glu-Met-Ser-Lys-Arg-Ser-Pro-(OH)NH$_2$ b307) RNH-Val-Xaa$_3$-Leu-Ser-Arg-Thr-Val-Arg-Xaa$_1$-Thr-Xaa$_2$-Xaa$_4$-Ser-Ile-[linker]-Leu- (SEQ ID NO:469)
Lys-Ala-Val-Ser-Lys-Glu-Met-Ser-Lys-Arg-Ser-Pro-(OH)NH$_2$ b308) RNH-Val-Pro-Xaa$_3$-Ser-Arg-Thr-Val-Arg-Xaa$_1$-Thr-Xaa$_2$-Xaa$_4$-Ser-Ile-[linker]-Leu- (SEQ ID NO:470)
Lys-Ala-Val-Ser-Lys-Glu-Met-Ser-Lys-Arg-Ser-Pro-(OH)NH$_2$ b309) RNH-Val-Pro-Leu-Xaa$_3$-Arg-Thr-Val-Arg-Xaa$_1$-Thr-Xaa$_2$-Xaa$_4$-Ser-Ile-[linker]-Leu- (SEQ ID NO:471)
Lys-Ala-Val-Ser-Lys-Glu-Met-Ser-Lys-Arg-Ser-Pro-(OH)NH$_2$ b310) RNH-Val-Pro-Leu-Ser-Xaa$_3$-Thr-Val-Arg-Xaa$_1$-Thr-Xaa$_2$-Xaa$_4$-Ser-Ile-[linker]-Leu- (SEQ ID NO:472)
Lys-Ala-Val-Ser-Lys-Glu-Met-Ser-Lys-Arg-Ser-Pro-(OH)NH$_2$ -continued b311) RNH-Val-Pro-Leu-Ser-Arg-Xaa$_3$-Val-Arg-Xaa$_1$-Thr-Xaa$_2$-Xaa$_4$-Ser-Ile-[linker]-Leu- (SEQ ID NO:473)
Lys-Ala-Val-Ser-Lys-<u>Glu</u>-Met-Ser-<u>Lys</u>-Arg-Ser-Pro-(OH)NH$_2$ b312) RNH-Val-Pro-Leu-Ser-Arg-Thr-Xaa$_3$-Arg-Xaa$_1$-Thr-Xaa$_2$-Xaa$_4$-Ser-Ile-[linker]-Leu- (SEQ ID NO:474)
Lys-Ala-Val-Ser-Lys-<u>Glu</u>-Met-Ser-<u>Lys</u>-Arg-Ser-Pro-(OH)NH$_2$ b313) RNH-Val-Pro-Leu-Ser-Arg-Thr-Val-Xaa$_3$-Xaa$_1$-Thr-Xaa$_2$-Xaa$_4$-Ser-Ile-[linker]-Leu- (SEQ ID NO:475)
Lys-Ala-Val-Ser-Lys-<u>Glu</u>-Met-Ser-<u>Lys</u>-Arg-Ser-Pro-(OH)NH$_2$ b314) RNH-Val-Pro-Leu-Ser-Arg-Thr-Val-Arg-Cys-Thr-Cys-Ile-Xaa$_4$-Ile-[linker]-Leu-Lys- (SEQ ID NO:476)
Lys-Ala-Val-Ser-Lys-<u>Glu</u>-Met-Ser-<u>Lys</u>-Arg-Ser-Pro-(OH)NH$_2$ b315) RNH-Xaa$_3$-Pro-Leu-Ser-Arg-Thr-Val-Arg-Xaa$_1$-Thr-Xaa$_2$-Ile-Xaa$_4$-Ile-[linker]-Leu- (SEQ ID NO:477)
Lys-Ala-Val-Ser-Lys-<u>Glu</u>-Met-Ser-<u>Lys</u>-Arg-Ser-Pro-(OH)NH$_2$ b316) RNH-Val-Xaa$_3$-Leu-Ser-Arg-Thr-Val-Arg-Xaa$_1$-Thr-Xaa$_2$-Ile-Xaa$_4$-Ile-[linker]-Leu- (SEQ ID NO:478)
Lys-Ala-Val-Ser-Lys-<u>Glu</u>-Met-Ser-<u>Lys</u>-Arg-Ser-Pro-(OH)NH$_2$ b317) RNH-Val-Pro-Xaa$_3$-Ser-Arg-Thr-Val-Arg-Xaa$_1$-Thr-Xaa$_2$-Ile-Xaa$_4$-Ile-[linker]-Leu- (SEQ ID NO:479)
Lys-Ala-Val-Ser-Lys-<u>Glu</u>-Met-Ser-<u>Lys</u>-Arg-Ser-Pro-(OH)NH$_2$ b318) RNH-Val-Pro-Leu-Xaa$_3$-Arg-Thr-Val-Arg-Xaa$_1$-Thr-Xaa$_2$-Ile-Xaa$_4$-Ile-[linker]-Leu- (SEQ ID NO:480)
Lys-Ala-Val-Ser-Lys-<u>Glu</u>-Met-Ser-<u>Lys</u>-Arg-Ser-Pro-(OH)NH$_2$ b319) RNH-Val-Pro-Leu-Ser-Xaa$_3$-Thr-Val-Arg-Xaa$_1$-Thr-Xaa$_2$-Ile-Xaa$_4$-Ile-[linker]-Leu- (SEQ ID NO:481)
Lys-Ala-Val-Ser-Lys-<u>Glu</u>-Met-Ser-<u>Lys</u>-Arg-Ser-Pro-(OH)NH$_2$ b320) RNH-Val-Pro-Leu-Ser-Arg-Xaa$_3$-Val-Arg-Xaa$_1$-Thr-Xaa$_2$-Ile-Xaa$_4$-Ile-[linker]-Leu- (SEQ ID NO:482)
Lys-Ala-Val-Ser-Lys-<u>Glu</u>-Met-Ser-<u>Lys</u>-Arg-Ser-Pro-(OH)NH$_2$ b321) RNH-Val-Pro-Leu-Ser-Arg-Thr-Xaa$_3$-Arg-Xaa$_1$-Thr-Xaa$_2$-Ile-Xaa$_4$-Ile-[linker]-Leu- (SEQ ID NO:483)
Lys-Ala-Val-Ser-Lys-<u>Glu</u>-Met-Ser-<u>Lys</u>-Arg-Ser-Pro-(OH)NH$_2$ b322) RNH-Val-Pro-Leu-Ser-Arg-Thr-Val-Xaa$_3$-Xaa$_1$-Thr-Xaa$_2$-Ile-Xaa$_4$-Ile-[linker]-Leu- (SEQ ID NO:484)
Lys-Ala-Val-Ser-Lys-<u>Glu</u>-Met-Ser-<u>Lys</u>-Arg-Ser-Pro-(OH)NH$_2$ b323) RNH-Val-Pro-Leu-Ser-Arg-Thr-Val-Arg-Cys-Thr-Cys-Ile-Ser-Xaa$_4$-[linker]-Leu- (SEQ ID NO:485)
Lys-Ala-Val-Ser-Lys-<u>Glu</u>-Met-Ser-<u>Lys</u>-Arg-Ser-Pro-(OH)NH$_2$ b324) RNH-Xaa$_3$-Pro-Leu-Ser-Arg-Thr-Val-Arg-Xaa$_1$-Thr-Xaa$_2$-Ile-Ser-Xaa$_4$-[linker]-Leu- (SEQ ID NO:486)
Lys-Ala-Val-Ser-Lys-<u>Glu</u>-Met-Ser-<u>Lys</u>-Arg-Ser-Pro-(OH)NH$_2$ b325) RNH-Val-Xaa$_3$-Leu-Ser-Arg-Thr-Val-Arg-Xaa$_1$-Thr-Xaa$_2$-Ile-Ser-Xaa$_4$-[linker]-Leu- (SEQ ID NO:487)
Lys-Ala-Val-Ser-Lys-<u>Glu</u>-Met-Ser-<u>Lys</u>-Arg-Ser-Pro-(OH)NH$_2$ b326) RNH-Val-Pro-Xaa$_3$-Ser-Arg-Thr-Val-Arg-Xaa$_1$-Thr-Xaa$_2$-Ile-Ser-Xaa$_4$-[linker]-Leu- (SEQ ID NO:488)
Lys-Ala-Val-Ser-Lys-<u>Glu</u>-Met-Ser-<u>Lys</u>-Arg-Ser-Pro-(OH)NH$_2$ b327) RNH-Val-Pro-Leu-Xaa$_3$-Arg-Thr-Val-Arg-Xaa$_1$-Thr-Xaa$_2$-Ile-Ser-Xaa$_4$-[linker]-Leu- (SEQ ID NO:489)
Lys-Ala-Val-Ser-Lys-<u>Glu</u>-Met-Ser-<u>Lys</u>-Arg-Ser-Pro-(OH)NH$_2$ b328) RNH-Val-Pro-Leu-Ser-Xaa$_3$-Thr-Val-Arg-Xaa$_1$-Thr-Xaa$_2$-Ile-Ser-Xaa$_4$-[linker]-Leu- (SEQ ID NO:490)
Lys-Ala-Val-Ser-Lys-<u>Glu</u>-Met-Ser-<u>Lys</u>-Arg-Ser-Pro-(OH)NH$_2$ b329) RNH-Val-Pro-Leu-Ser-Arg-Xaa$_3$-Val-Arg-Xaa$_1$-Thr-Xaa$_2$-Ile-Ser-Xaa$_4$-[linker]-Leu- (SEQ ID NO:491)
Lys-Ala-Val-Ser-Lys-<u>Glu</u>-Met-Ser-<u>Lys</u>-Arg-Ser-Pro-(OH)NH$_2$ b330) RNH-Val-Pro-Leu-Ser-Arg-Thr-Xaa$_3$-Arg-Xaa$_1$-Thr-Xaa$_2$-Ile-Ser-Xaa$_4$-[linker]-Leu- (SEQ ID NO:492)
Lys-Ala-Val-Ser-Lys-<u>Glu</u>-Met-Ser-<u>Lys</u>-Arg-Ser-Pro-(OH)NH$_2$ b331) RNH-Val-Pro-Leu-Ser-Arg-Thr-Val-Xaa$_3$-Xaa$_1$-Thr-Xaa$_2$-Ile-Ser-Xaa$_4$-[linker]-Leu- (SEQ ID NO:493)
Lys-Ala-Val-Ser-Lys-<u>Glu</u>-Met-Ser-<u>Lys</u>-Arg-Ser-Pro-(OH)NH$_2$ IP-10-(1–17)-[linker]-IP-10-(65–77)-cyclic (Glu71–Lys74) acid or amide b332) RNH-Val-Pro-Leu-Ser-Arg-Thr-Val-Arg-Cys-Thr-Cys-Ile-Ser-Ile-Ser-Asn-Gln- (SEQ ID NO:494)
[linker]-Leu-Lys-Ala-Val-Ser-Lys-<u>Glu</u>-Met-Ser-<u>Lys</u>-Arg-Ser-Pro-(OH)NH$_2$ b333) RNH-Xaa$_3$-Pro-Leu-Ser-Arg-Thr-Val-Arg-Xaa$_1$-Thr-Xaa$_2$-Ile-Ser-Ile-Ser-Asn-Gln- (SEQ ID NO:495)
[linker]-Leu-Lys-Ala-Val-Ser-Lys-<u>Glu</u>-Met-Ser-<u>Lys</u>-Arg-Ser-Pro-(OH)NH$_2$ b334) RNH-Val-Xaa$_3$-Leu-Ser-Arg-Thr-Val-Arg-Xaa$_1$-Thr-Xaa$_2$-Ile-Ser-Ile-Ser-Asn-Gln- (SEQ ID NO:496)
[linker]-Leu-Lys-Ala-Val-Ser-Lys-<u>Glu</u>-Met-Ser-<u>Lys</u>-Arg-Ser-Pro-(OH)NH$_2$ b335) RNH-Val-Pro-Xaa$_3$-Ser-Arg-Thr-Val-Arg-Xaa$_1$-Thr-Xaa$_2$-Ile-Ser-Ile-Ser-Asn-Gln- (SEQ ID NO:497)
[linker]-Leu-Lys-Ala-Val-Ser-Lys-<u>Glu</u>-Met-Ser-<u>Lys</u>-Arg-Ser-Pro-(OH)NH$_2$ b336) RNH-Val-Pro-Leu-Xaa$_3$-Arg-Thr-Val-Arg-Xaa$_1$-Thr-Xaa$_2$-Ile-Ser-Ile-Ser-Asn-Gln- (SEQ ID NO:498)
[linker]-Leu-Lys-Ala-Val-Ser-Lys-<u>Glu</u>-Met-Ser-<u>Lys</u>-Arg-Ser-Pro-(OH)NH$_2$ -continued b337) RNH-Val-Pro-Leu-Ser-Xaa$_3$-Thr-Val-Arg-Xaa$_1$-Thr-Xaa$_2$-Ile-Ser-Ile-Ser-Asn-Gln-  (SEQ ID NO:499)
[linker]-Leu-Lys-Ala-Val-Ser-Lys-<u>Glu</u>-Met-Ser-<u>Lys</u>-Arg-Ser-Pro-(OH)NH$_2$ b338) RNH-Val-Pro-Leu-Ser-Arg-Xaa$_3$-Val-Arg-Xaa$_1$-Thr-Xaa$_2$-Ile-Ser-Ile-Ser-Asn-Gln-  (SEQ ID NO:500)
[linker]-Leu-Lys-Ala-Val-Ser-Lys-<u>Glu</u>-Met-Ser-<u>Lys</u>-Arg-Ser-Pro-(OH)NH$_2$ b339) RNH-Val-Pro-Leu-Ser-Arg-Thr-Xaa$_3$-Arg-Xaa$_1$-Thr-Xaa$_2$-Ile-Ser-Ile-Ser-Asn-Gln-  (SEQ ID NO:501)
[linker]-Leu-Lys-Ala-Val-Ser-Lys-<u>Glu</u>-Met-Ser-<u>Lys</u>-Arg-Ser-Pro-(OH)NH$_2$ b340) RNH-Val-Pro-Leu-Ser-Arg-Thr-Val-Xaa$_3$-Xaa$_1$-Thr-Xaa$_2$-Ile-Ser-Ile-Ser-Asn-Gln-  (SEQ ID NO:502)
[linker]-Leu-Lys-Ala-Val-Ser-Lys-<u>Glu</u>-Met-Ser-<u>Lys</u>-Arg-Ser-Pro-(OH)NH$_2$ b341) RNH-Val-Pro-Leu-Ser-Arg-Thr-Val-Arg-Cys-Thr-Cys-Xaa$_4$-Ser-Ile-Ser-Asn-Gln-  (SEQ ID NO:503)
[linker]-Leu-Lys-Ala-Val-Ser-Lys-<u>Glu</u>-Met-Ser-<u>Lys</u>-Arg-Ser-Pro-(OH)NH$_2$ b342) RNH-Xaa$_3$-Pro-Leu-Ser-Arg-Thr-Val-Arg-Xaa$_1$-Thr-Xaa$_2$-Xaa$_4$-Ser-Ile-Ser-Asn-Gln-  (SEQ ID NO:504)
[linker]-Leu-Lys-Ala-Val-Ser-Lys-<u>Glu</u>-Met-Ser-<u>Lys</u>-Arg-Ser-Pro-(OH)NH$_2$ b343) RNH-Val-Xaa$_3$-Leu-Ser-Arg-Thr-Val-Arg-Xaa$_1$-Thr-Xaa$_2$-Xaa$_4$-Ser-Ile-Ser-Asn-Gln-  (SEQ ID NO:505)
[linker]-Leu-Lys-Ala-Val-Ser-Lys-<u>Glu</u>-Met-Ser-<u>Lys</u>-Arg-Ser-Pro-(OH)NH$_2$ b344) RNH-Val-Pro-Xaa$_3$-Ser-Arg-Thr-Val-Arg-Xaa$_1$-Thr-Xaa$_2$-Xaa$_4$-Ser-Ile-Ser-Asn-Gln-  (SEQ ID NO:506)
[linker]-Leu-Lys-Ala-Val-Ser-Lys-<u>Glu</u>-Met-Ser-<u>Lys</u>-Arg-Ser-Pro-(OH)NH$_2$ b345) RNH-Val-Pro-Leu-Xaa$_3$-Arg-Thr-Val-Arg-Xaa$_1$-Thr-Xaa$_2$-Xaa$_4$-Ser-Ile-Ser-Asn-Gln-  (SEQ ID NO:507)
[linker]-Leu-Lys-Ala-Val-Ser-Lys-<u>Glu</u>-Met-Ser-<u>Lys</u>-Arg-Ser-Pro-(OH)NH$_2$ b346) RNH-Val-Pro-Leu-Ser-Xaa$_3$-Thr-Val-Arg-Xaa$_1$-Thr-Xaa$_2$-Xaa$_4$-Ser-Ile-Ser-Asn-Gln-  (SEQ ID NO:508)
[linker]-Leu-Lys-Ala-Val-Ser-Lys-<u>Glu</u>-Met-Ser-<u>Lys</u>-Arg-Ser-Pro-(OH)NH$_2$ b347) RNH-Val-Pro-Leu-Ser-Arg-Xaa$_3$-Val-Arg-Xaa$_1$-Thr-Xaa$_2$-Xaa$_4$-Ser-Ile-Ser-Asn-Gln-  (SEQ ID NO:509)
[linker]-Leu-Lys-Ala-Val-Ser-Lys-<u>Glu</u>-Met-Ser-<u>Lys</u>-Arg-Ser-Pro-(OH)NH$_2$ b348) RNH-Val-Pro-Leu-Ser-Arg-Thr-Xaa$_3$-Arg-Xaa$_1$-Thr-Xaa$_2$-Xaa$_4$-Ser-Ile-Ser-Asn-Gln-  (SEQ ID NO:510)
[linker]-Leu-Lys-Ala-Val-Ser-Lys-<u>Glu</u>-Met-Ser-<u>Lys</u>-Arg-Ser-Pro-(OH)NH$_2$ b349) RNH-Val-Pro-Leu-Ser-Arg-Thr-Val-Xaa$_3$-Xaa$_1$-Thr-Xaa$_2$-Xaa$_4$-Ser-Ile-Ser-Asn-Gln-  (SEQ ID NO:511)
[linker]-Leu-Lys-Ala-Val-Ser-Lys-<u>Glu</u>-Met-Ser-<u>Lys</u>-Arg-Ser-Pro-(OH)NH$_2$ b350) RNH-Val-Pro-Leu-Ser-Arg-Thr-Val-Arg-Cys-Thr-Cys-Ile-Xaa$_4$-Ile-Ser-Asn-Gln  (SEQ ID NO:512)
[linker]-Leu-Lys-Ala-Val-Ser-Lys-<u>Glu</u>-Met-Ser-<u>Lys</u>-Arg-Ser-Pro-(OH)NH$_2$ b351) RNH-Xaa$_3$-Pro-Leu-Ser-Arg-Thr-Val-Arg-Xaa$_1$-Thr-Xaa$_2$-Ile-Xaa$_4$-Ile-Ser-Asn-Gln-  (SEQ ID NO:513)
[linker]-Leu-Lys-Ala-Val-Ser-Lys-<u>Glu</u>-Met-Ser-<u>Lys</u>-Arg-Ser-Pro-(OH)NH$_2$ b352) RNH-Val-Xaa$_3$-Leu-Ser-Arg-Thr-Val-Arg-Xaa$_1$-Thr-Xaa$_2$-Ile-Xaa$_4$-Ile-Ser-Asn-Gln-  (SEQ ID NO:514)
[linker]-Leu-Lys-Ala-Val-Ser-Lys-<u>Glu</u>-Met-Ser-<u>Lys</u>-Arg-Ser-Pro-(OH)NH$_2$ b353) RNH-Val-Pro-Xaa$_3$-Ser-Arg-Thr-Val-Arg-Xaa$_1$-Thr-Xaa$_2$-Ile-Xaa$_4$-Ile-Ser-Asn-Gln-  (SEQ ID NO:515)
[linker]-Leu-Lys-Ala-Val-Ser-Lys-<u>Glu</u>-Met-Ser-<u>Lys</u>-Arg-Ser-Pro-(OH)NH$_2$ b354) RNH-Val-Pro-Leu-Xaa$_3$-Arg-Thr-Val-Arg-Xaa$_1$-Thr-Xaa$_2$-Ile-Xaa$_4$-Ile-Ser-Asn-Gln-  (SEQ ID NO:516)
[linker]-Leu-Lys-Ala-Val-Ser-Lys-<u>Glu</u>-Met-Ser-<u>Lys</u>-Arg-Ser-Pro-(OH)NH$_2$ b355) RNH-Val-Pro-Leu-Ser-Xaa$_3$-Thr-Val-Arg-Xaa$_1$-Thr-Xaa$_2$-Ile-Xaa$_4$-Ile-Ser-Asn-Gln-  (SEQ ID NO:517)
[linker]-Leu-Lys-Ala-Val-Ser-Lys-<u>Glu</u>-Met-Ser-<u>Lys</u>-Arg-Ser-Pro-(OH)NH$_2$ b356) RNH-Val-Pro-Leu-Ser-Arg-Xaa$_3$-Val-Arg-Xaa$_1$-Thr-Xaa$_2$-Ile-Xaa$_4$-Ile-Ser-Asn-Gln-  (SEQ ID NO:518)
[linker]-Leu-Lys-Ala-Val-Ser-Lys-<u>Glu</u>-Met-Ser-<u>Lys</u>-Arg-Ser-Pro-(OH)NH$_2$ b357) RNH-Val-Pro-Leu-Ser-Arg-Thr-Xaa$_3$-Arg-Xaa$_1$-Thr-Xaa$_2$-Ile-Xaa$_4$-Ile-Ser-Asn-Gln-  (SEQ ID NO:519)
[linker]-Leu-Lys-Ala-Val-Ser-Lys-<u>Glu</u>-Met-Ser-<u>Lys</u>-Arg-Ser-Pro-(OH)NH$_2$ b358) RNH-Val-Pro-Leu-Ser-Arg-Thr-Val-Xaa$_3$-Xaa$_1$-Thr-Xaa$_2$-Ile-Xaa$_4$-Ile-Ser-Asn-Gln-  (SEQ ID NO:520)
[linker]-Leu-Lys-Ala-Val-Ser-Lys-<u>Glu</u>-Met-Ser-<u>Lys</u>-Arg-Ser-Pro-(OH)NH$_2$ b359) RNH-Val-Pro-Leu-Ser-Arg-Thr-Val-Arg-Cys-Thr-Cys-Ile-Ser-Xaa$_4$-Ser-Asn-Gln-  (SEQ ID NO:521)
[linker]-Leu-Lys-Ala-Val-Ser-Lys-<u>Glu</u>-Met-Ser-<u>Lys</u>-Arg-Ser-Pro-(OH)NH$_2$ b360) RNH-Xaa$_3$-Pro-Leu-Ser-Arg-Thr-Val-Arg-Xaa$_1$-Thr-Xaa$_2$-Ile-Ser-Xaa$_4$-Asn-Gln-  (SEQ ID NO:522)
[linker]-Leu-Lys-Ala-Val-Ser-Lys-<u>Glu</u>-Met-Ser-<u>Lys</u>-Arg-Ser-Pro-(OH)NH$_2$ b361) RNH-Val-Xaa$_3$-Leu-Ser-Arg-Thr-Val-Arg-Xaa$_1$-Thr-Xaa$_2$-Ile-Ser-Xaa$_4$-Ser-Asn-Gln-  (SEQ ID NO:523)
[linker]-Leu-Lys-Ala-Val-Ser-Lys-<u>Glu</u>-Met-Ser-<u>Lys</u>-Arg-Ser-Pro-(OH)NH$_2$ b362) RNH-Val-Pro-Xaa$_3$-Ser-Arg-Thr-Val-Arg-Xaa$_1$-Thr-Xaa$_2$-Ile-Ser-Xaa$_4$-Ser-Asn-Gln-  (SEQ ID NO:524)
[linker]-Leu-Lys-Ala-Val-Ser-Lys-<u>Glu</u>-Met-Ser-<u>Lys</u>-Arg-Ser-Pro-(OH)NH$_2$ b363) RNH-Val-Pro-Leu-Xaa$_3$-Arg-Thr-Val-Arg-Xaa$_1$-Thr-Xaa$_2$-Ile-Ser-Xaa$_4$-Ser-Asn-Gln-  (SEQ ID NO:525)
[linker]Leu-Lys-Ala-Val-Ser-Lys-<u>Glu</u>-Met-Ser-<u>Lys</u>-Arg-Ser-Pro-(OH)NH$_2$ -continued b364) RNH-Val-Pro-Leu-Ser-Xaa₃-Thr-Val-Arg-Xaa₁-Thr-Xaa₂-Ile-Ser-Xaa₄-Ser-Asn-Gln- (SEQ ID NO:526)
[linker]Leu-Lys-Ala-Val-Ser-Lys-<u>Glu</u>-Met-Ser-<u>Lys</u>-Arg-Ser-Pro-(OH)NH₂ b365) RNH-Val-Pro-Leu-Ser-Arg-Xaa₃-Val-Arg-Xaa₁-Thr-Xaa₂-Ile-Ser-Xaa₄-Ser-Asn-Gln- (SEQ ID NO:527)
[linker]-Leu-Lys-Ala-Val-Ser-Lys-<u>Glu</u>-Met-Ser-<u>Lys</u>-Arg-Ser-Pro-(OH)NH₂ b366) RNH-Val-Pro-Leu-Ser-Arg-Thr-Xaa₃-Arg-Xaa₁-Thr-Xaa₂-Ile-Ser-Xaa₄-Ser-Asn-Gln- (SEQ ID NO:528)
[linker]-Leu-Lys-Ala-Val-Ser-Lys-<u>Glu</u>-Met-Ser-<u>Lys</u>-Arg-Ser-Pro-(OH)NH₂ b367) RNH-Val-Pro-Leu-Ser-Arg-Thr-Val-Xaa₃-Xaa₁-Thr-Xaa₂-Ile-Ser-Xaa₄-Ser-Asn-Gln- (SEQ ID NO:529)
[linker]-Leu-Lys-Ala-Val-Ser-Lys-<u>Glu</u>-Met-Ser-<u>Lys</u>-Arg-Ser-Pro-(OH)NH₂ b368) RNH-Val-Pro-Leu-Ser-Arg-Thr-Val-Arg-Cys-Thr-Cys-Ile-Ser-Ile-Ser-Xaa₄-Gln- (SEQ ID NO:530)
[linker]-Leu-Lys-Ala-Val-Ser-Lys-<u>Glu</u>-Met-Ser-<u>Lys</u>-Arg-Ser-Pro-(OH)NH₂ b369) RNH-Xaa₃-Pro-Leu-Ser-Arg-Thr-Val-Arg-Xaa₁-Thr-Xaa₂-Ile-Ser-Ile-Ser-Xaa₄-Gln- (SEQ ID NO:531)
[linker]-Leu-Lys-Ala-Val-Ser-Lys-<u>Glu</u>-Met-Ser-<u>Lys</u>-Arg-Ser-Pro-(OH)NH₂ b370) RNH-Val-Xaa₃-Leu-Ser-Arg-Thr-Val-Arg-Xaa₁-Thr-Xaa₂-Ile-Ser-Ile-Ser-Xaa₄-Gln- (SEQ ID NO:532)
[linker]-Leu-Lys-Ala-Val-Ser-Lys-<u>Glu</u>-Met-Ser-<u>Lys</u>-Arg-Ser-Pro-(OH)NH₂ b371) RNH-Val-Pro-Xaa₃-Ser-Arg-Thr-Val-Arg-Xaa₁-Thr-Xaa₂-Ile-Ser-Ile-Ser-Xaa₄-Gln- (SEQ ID NO:533)
[linker]-Leu-Lys-Ala-Val-Ser-Lys-<u>Glu</u>-Met-Ser-<u>Lys</u>-Arg-Ser-Pro-(OH)NH₂ b372) RNH-Val-Pro-Leu-Xaa₃-Arg-Thr-Val-Arg-Xaa₁-Thr-Xaa₂-Ile-Ser-Ile-Ser-Xaa₄-Gln- (SEQ ID NO:534)
[linker]-Leu-Lys-Ala-Val-Ser-Lys-<u>Glu</u>-Met-Ser-<u>Lys</u>-Arg-Ser-Pro-(OH)NH₂ b373) RNH-Val-Pro-Leu-Ser-Xaa₃-Thr-Val-Arg-Xaa₁-Thr-Xaa₂-Ile-Ser-Ile-Ser-Xaa₄-Gln- (SEQ ID NO:535)
[linker]-Leu-Lys-Ala-Val-Ser-Lys-<u>Glu</u>-Met-Ser-<u>Lys</u>-Arg-Ser-Pro-(OH)NH₂ b374) RNH-Val-Pro-Leu-Ser-Arg-Xaa₃-Val-Arg-Xaa₁-Thr-Xaa₂-Ile-Ser-Ile-Ser-Xaa₄-Gln- (SEQ ID NO:536)
[linker]-Leu-Lys-Ala-Val-Ser-Lys-<u>Glu</u>-Met-Ser-<u>Lys</u>-Arg-Ser-Pro-(OH)NH₂ b375) RNH-Val-Pro-Leu-Ser-Arg-Thr-Xaa₃-Arg-Xaa₁-Thr-Xaa₂-Ile-Ser-Ile-Ser-Xaa₄-Gln- (SEQ ID NO:537)
[linker]-Leu-Lys-Ala-Val-Ser-Lys-<u>Glu</u>-Met-Ser-<u>Lys</u>-Arg-Ser-Pro-(OH)NH₂ b376) RNH-Val-Pro-Leu-Ser-Arg-Thr-Val-Xaa₃-Xaa₁-Thr-Xaa₂-Ile-Ser-Ile-Ser-Xaa₄-Gln- (SEQ ID NO:538)
[linker]-Leu-Lys-Ala-Val-Ser-Lys-<u>Glu</u>-Met-Ser-<u>Lys</u>-Arg-Ser-Pro-(OH)NH₂ b377) RNH-Val-Pro-Leu-Ser-Arg-Thr-Val-Arg-Cys-Thr-Cys-Ile-Ser-Ile-Ser--Gln-Xaa₄- (SEQ ID NO:539)
[linker]-Leu-Lys-Ala-Val-Ser-Lys-<u>Glu</u>-Met-Ser-<u>Lys</u>-Arg-Ser-Pro-(OH)NH₂ b378) RNH-Xaa₃-Pro-Leu-Ser-Arg-Thr-Val-Arg-Xaa₁-Thr-Xaa₂-Ile-Ser-Ile-Ser-Gln-Xaa₄- (SEQ ID NO:540)
[linker]-Leu-Lys-Ala-Val-Ser-Lys-<u>Glu</u>-Met-Ser-<u>Lys</u>-Arg-Ser-Pro-(OH)NH₂ b379) RNH-Val-Xaa₃-Leu-Ser-Arg-Thr-Val-Arg-Xaa₁-Thr-Xaa₂-Ile-Ser-Ile-Ser-GlnXaa₄- (SEQ ID NO:541)
[linker]-Leu-Lys-Ala-Val-Ser-Lys-<u>Glu</u>-Met-Ser-<u>Lys</u>-Arg-Ser-Pro-(OH)NH₂ b380) RNH-Val-Pro-Xaa₃-Ser-Arg-Thr-Val-Arg-Xaa₁-Thr-Xaa₂-Ile-Ser-Ile-Ser-GlnXaa₄- (SEQ ID NO:542)
[linker]-Leu-Lys-Ala-Val-Ser-Lys-<u>Glu</u>-Met-Ser-<u>Lys</u>-Arg-Ser-Pro-(OH)NH₂ b381) RNH-Val-Pro-Leu-Xaa₃-Arg-Thr-Val-Arg-Xaa₁-Thr-Xaa₂-Ile-Ser-Ile-Ser-GlnXaa₄- (SEQ ID NO:543)
[linker]-Leu-Lys-Ala-Val-Ser-Lys-<u>Glu</u>-Met-Ser-<u>Lys</u>-Arg-Ser-Pro-(OH)NH₂ b382) RNH-Val-Pro-Leu-Ser-Xaa₃-Thr-Val-Arg-Xaa₁-Thr-Xaa₂-Ile-Ser-Ile-Ser-GlnXaa₄- (SEQ ID NO:544)
[linker]-Leu-Lys-Ala-Val-Ser-Lys-<u>Glu</u>-Met-Ser-<u>Lys</u>-Arg-Ser-Pro-(OH)NH₂ b383) RNH-Val-Pro-Leu-Ser-Arg-Xaa₃-Val-Arg-Xaa₁-Thr-Xaa₂-Ile-Ser-Ile-Ser-Gln-Xaa₄- (SEQ ID NO:545)
[linker]-Leu-Lys-Ala-Val-Ser-Lys-<u>Glu</u>-Met-Ser-<u>Lys</u>-Arg-Ser-Pro-(OH)NH₂ b384) RNH-Val-Pro-Leu-Ser-Arg-Thr-Xaa₃-Arg-Xaa₁-Thr-Xaa₂-Ile-Ser-Ile-Ser-Gln-Xaa₄- (SEQ ID NO:546)
[linker]-Leu-Lys-Ala-Val-Ser-Lys-<u>Glu</u>-Met-Ser-<u>Lys</u>-Arg-Ser-Pro-(OH)NH₂ b385) RNH-Val-Pro-Leu-Ser-Arg-Thr-Val-Xaa₃-Xaa₁-Thr-Xaa₂-Ile-Ser-Ile-Ser-Gln-Xaa₄- (SEQ ID NO:548)
[linker]-Leu-Lys-Ala-Val-Ser-Lys-<u>Glu</u>-Met-Ser-<u>Lys</u>-Arg-Ser-Pro-(OH)NH₂

IP-10-(1–14)-[linker]-IP-10-(54–66)-cyclic(Glu57–Lys62) acid or amide b386) RNH-Val-Pro-Leu-Ser-Arg-Thr-Val-Arg-Cys-Thr-Cys-Ile-Ser-Ile-[linker]-Leu-Asn- (SEQ ID NO:549)
Pro-<u>Glu</u>-Ser-Lys-Ala-Ile-<u>Lys</u>-Asn-Leu-Leu-Lys-(OH)NH₂ b387) RNH-Xaa₃-Pro-Leu-Ser-Arg-Thr-Val-Arg-Xaa₁-Thr-Xaa₂-Ile-Ser-Ile-[linker]-Leu- (SEQ ID NO:550)
Asn-Pro-<u>Glu</u>-Ser-Lys-Ala-Ile-<u>Lys</u>-Asn-Leu-Leu-Lys-(OH)NH₂ b388) RNH-Val-Xaa₃-Leu-Ser-Arg-Thr-Val-Arg-Xaa₁-Thr-Xaa₂-Ile-Ser-Ile-[linker]-Leu- (SEQ ID NO:551)
Asn-Pro-<u>Glu</u>-Ser-Lys-Ala-Ile-<u>Lys</u>-Asn-Leu-Leu-Lys-(OH)NH₂ b389) RNH-Val-Pro-Xaa₃-Ser-Arg-Thr-Val-Arg-Xaa₁-Thr-Xaa₂-Ile-Ser-Ile-[linker]-Leu- (SEQ ID NO:552)
Asn-Pro-<u>Glu</u>-Ser-Lys-Ala-Ile-<u>Lys</u>-Asn-Leu-Leu-Lys-(OH)NH₂

-continued b400) RNH-Val-Pro-Leu-Xaa$_3$-Arg-Thr-Val-Arg-Xaa$_1$-Thr-Xaa$_2$-Ile-Ser-Ile-[linker]-Leu-    (SEQ ID NO:553)
     Asn-Pro-<u>Glu</u>-Ser-Lys-Ala-Ile-<u>Lys</u>-Asn-Leu-Leu-Lys-(OH)NH$_2$ b401) RNH-Val-Pro-Leu-Ser-Xaa$_3$-Thr-Val-Arg-Xaa$_1$-Thr-Xaa$_2$-Ile-Ser-Ile-[linker]-Leu-    (SEQ ID NO:554)
     Asn-Pro-<u>Glu</u>-Ser-Lys-Ala-Ile-<u>Lys</u>-Asn-Leu-Leu-Lys-(OH)NH$_2$ b402) RNH-Val-Pro-Leu-Ser-Arg-Xaa$_3$-Val-Arg-Xaa$_1$-Thr-Xaa$_2$-Ile-Ser-Ile-[linker]-Leu-    (SEQ ID NO:555)
     Asn-Pro-<u>Glu</u>-Ser-Lys-Ala-Ile-<u>Lys</u>-Asn-Leu-Leu-Lys-(OH)NH$_2$ b403) RNH-Val-Pro-Leu-Ser-Arg-Thr-Xaa$_3$-Arg-Xaa$_1$-Thr-Xaa$_2$-Ile-Ser-Ile-[linker]-Leu-    (SEQ ID NO:556)
     Asn-Pro-<u>Glu</u>-Ser-Lys-Ala-Ile-<u>Lys</u>-Asn-Leu-Leu-Lys-(OH)NH$_2$ b404) RNH-Val-Pro-Leu-Ser-Arg-Thr-Val-Xaa$_3$-Xaa$_1$-Thr-Xaa$_2$-Ile-Ser-Ile-[linker]-Leu-    (SEQ ID NO:557)
     Asn-Pro-<u>Glu</u>-Ser-Lys-Ala-Ile-<u>Lys</u>-Asn-Leu-Leu-Lys-(OH)NH$_2$ b405) RNH-Val-Pro-Leu-Ser-Arg-Thr-Val-Arg-Cys-Thr-Cys-Xaa$_4$Ser-Ile-[linker]-Leu-Asn-       (SEQ ID NO:558)
     Pro-<u>Glu</u>-Ser-Lys-Ala-Ile-<u>Lys</u>-Asn-Leu-Leu-Lys(OH)NH$_2$ b406) RNH-Xaa$_3$-Pro-Leu-Ser-Arg-Thr-Val-Arg-Xaa$_1$-Thr-Xaa$_2$-Xaa$_4$-Ser-Ile-[linker]-Leu-  (SEQ ID NO:559)
     Asn-Pro-<u>Glu</u>-Ser-Lys-Ala-Ile-<u>Lys</u>-Asn-Leu-Leu-Lys-(OH)NH$_2$ b407) RNH-Val-Xaa$_3$-Leu-Ser-Arg-Thr-Val-Arg-Xaa$_1$-Thr-Xaa$_2$-Xaa$_4$-Ser-Ile-[linker]-Leu-  (SEQ ID NO:560)
     Asn-Pro-<u>Glu</u>-Ser-Lys-Ala-Ile-<u>Lys</u>-Asn-Leu-Leu-Lys-(OH)NH$_2$ b408) RNH-Val-Pro-Xaa$_3$-Ser-Arg-Thr-Val-Arg-Xaa$_1$-Thr-Xaa$_2$-Xaa$_4$-Ser-Ile-[linker]-Leu-  (SEQ ID NO:561)
     Asn-Pro-<u>Glu</u>-Ser-Lys-Ala-Ile-<u>Lys</u>-Asn-Leu-Leu-Lys-(OH)NH$_2$ b409) RNH-Val-Pro-Leu-Xaa$_3$-Arg-Thr-Val-Arg-Xaa$_1$-Thr-Xaa$_2$-Xaa$_4$-Ser-Ile-[linker]-Leu-  (SEQ ID NO:562)
     Asn-Pro-<u>Glu</u>-Ser-Lys-Ala-Ile-<u>Lys</u>-Asn-Leu-Leu-Lys-(OH)NH$_2$ b410) RNH-Val-Pro-Leu-Ser-Xaa$_3$-Thr-Val-Arg-Xaa$_1$-Thr-Xaa$_2$-Xaa$_4$-Ser-Ile-[linker]-Leu-  (SEQ ID NO:563)
     Asn-Pro-<u>Glu</u>-Ser-Lys-Ala-Ile-<u>Lys</u>-Asn-Leu-Leu-Lys-(OH)NH$_2$ b411) RNH-Val-Pro-Leu-Ser-Arg-Xaa$_3$-Val-Arg-Xaa$_1$-Thr-Xaa$_2$-Xaa$_4$-Ser-Ile-[linker]-Leu-  (SEQ ID NO:564)
     Asn-Pro-<u>Glu</u>-Ser-Lys-Ala-Ile-<u>Lys</u>-Asn-Leu-Leu-Lys-(OH)NH$_2$ b412) RNH-Val-Pro-Leu-Ser-Arg-Thr-Xaa$_3$-Arg-Xaa$_1$-Thr-Xaa$_2$-Xaa$_4$-Ser-Ile-[linker]-Leu-  (SEQ ID NO:565)
     Asn-Pro-<u>Glu</u>-Ser-Lys-Ala-Ile-<u>Lys</u>-Asn-Leu-Leu-Lys-(OH)NH$_2$ b413) RNH-Val-Pro-Leu-Ser-Arg-Thr-Val-Xaa$_3$-Xaa$_1$-Thr-Xaa$_2$-Xaa$_4$-Ser-Ile-[linker]-Leu-  (SEQ ID NO:566)
     Asn-Pro-<u>Glu</u>-Ser-Lys-Ala-Ile-<u>Lys</u>-Asn-Leu-Leu-Lys-(OH)NH$_2$ b414) RNH-Val-Pro-Leu-Ser-Arg-Thr-Val-Arg-Cys-Thr-Cys-Ile-Xaa$_4$-Ile-[linker]-Leu-         (SEQ ID NO:567)
     Asn-Pro-<u>Glu</u>-Ser-Lys-Ala-Ile-<u>Lys</u>-Asn-Leu-Leu-Lys-(OH)NH$_2$ b415) RNH-Xaa$_3$-Pro-Leu-Ser-Arg-Thr-Val-Arg-Xaa$_1$-Thr-Xaa$_2$-Ile-Xaa$_4$-Ile-[linker]-Leu-  (SEQ ID NO:568)
     Asn-Pro-<u>Glu</u>-Ser-Lys-Ala-Ile-<u>Lys</u>-Asn-Leu-Leu-Lys-(OH)NH$_2$ b416) RNH-Val-Xaa$_3$-Leu-SerArg-Thr-Val-Arg-Xaa$_1$-Thr-Xaa$_2$-Ile-Xaa$_4$-Ile-[linker]-Leu-   (SEQ ID NO:569)
     Asn-Pro-<u>Glu</u>-Ser-Lys-Ala-Ile-<u>Lys</u>-Asn-Leu-Leu-Lys-(OH)NH$_2$ b417) RNH-Val-Pro-Xaa$_3$-Ser-Arg-Thr-Val-Arg-Xaa$_1$-Thr-Xaa$_2$-Ile-Xaa$_4$-Ile-[linker]-Leu-  (SEQ ID NO:570)
     Asn-Pro-<u>Glu</u>-Ser-Lys-Ala-Ile-<u>Lys</u>-Asn-Leu-Leu-Lys-(OH)NH$_2$ b418) RNH-Val-Pro-Leu-Xaa$_3$-Arg-Thr-Val-Arg-Xaa$_1$-Thr-Xaa$_2$-Ile-Xaa$_4$-Ile-[linker]-Leu-  (SEQ ID NO:571)
     Asn-Pro-<u>Glu</u>-Ser-Lys-Ala-Ile-<u>Lys</u>-Asn-Leu-Leu-Lys-(OH)NH$_2$ b419) RNH-Val-Pro-Leu-Ser-Xaa$_3$-Thr-Val-Arg-Xaa$_1$-Thr-Xaa$_2$-Ile-Xaa$_4$-Ile-[linker]-Leu-  (SEQ ID NO:572)
     Asn-Pro-<u>Glu</u>-Ser-Lys-Ala-Ile-<u>Lys</u>-Asn-Leu-Leu-Lys-(OH)NH$_2$ b420) RNH-Val-Pro-Leu-Ser-Arg-Xaa$_3$-Val-Arg-Xaa$_1$-Thr-Xaa$_2$-Ile-Xaa$_4$-Ile-[linker]-Leu-  (SEQ ID NO:573)
     Asn-Pro-<u>Glu</u>-Ser-Lys-Ala-Ile-<u>Lys</u>-Asn-Leu-Leu-Lys-(OH)NH$_2$ b421) RNH-Val-Pro-Leu-Ser-Arg-Thr-Xaa$_3$-Arg-Xaa$_1$-Thr-Xaa$_2$-Ile-Xaa$_4$-Ile-[linker]-Leu-  (SEQ ID NO:574)
     Asn-Pro-<u>Glu</u>-Ser-Lys-Ala-Ile-<u>Lys</u>-Asn-Leu-Leu-Lys-(OH)NH$_2$ b422) RNH-Val-Pro-Leu-Ser-Arg-Thr-Val-Xaa$_3$-Xaa$_1$-Thr-Xaa$_2$-Ile-Xaa$_4$-Ile-[linker]-Leu-  (SEQ ID NO:575)
     Asn-Pro-<u>Glu</u>-Ser-Lys-Ala-Ile-<u>Lys</u>-Asn-Leu-Leu-Lys-(OH)NH$_2$ b423) RNH-Val-Pro-Leu-Ser-Arg-Thr-Val-Arg-Cys-Thr-Cys-Ile-Ser-Xaa$_4$-[linker]-Leu-         (SEQ ID NO:576)
     Asn-Pro-<u>Glu</u>-Ser-Lys-Ala-Ile-<u>Lys</u>-Asn-Leu-Leu-Lys-(OH)NH$_2$ b424) RNH-Xaa$_3$-Pro-Leu-Ser-Arg-Thr-Val-Arg-Xaa$_1$-Thr-Xaa$_2$-Ile-Ser-Xaa$_4$-[linker]-Leu-  (SEQ ID NO:577)
     Asn-Pro-<u>Glu</u>-Ser-Lys-Ala-Ile-<u>Lys</u>-Asn-Leu-Leu-Lys-(OH)NH$_2$ b425) RNH-Val-Xaa$_3$-Leu-Ser-Arg-Thr-Val-Arg-Xaa$_1$-Thr-Xaa$_2$-Ile-Ser-Xaa$_4$-[linker]-Leu-  (SEQ ID NO:578)
     Asn-Pro-<u>Glu</u>-Ser-Lys-Ala-Ile-<u>Lys</u>-Asn-Leu-Leu-Lys-(OH)NH$_2$ -continued b426) RNH-Val-Pro-Xaa₃-Ser-Arg-Thr-Val-Arg-Xaa₁-Thr-Xaa₂-Ile-Ser-Xaa₄-[linker]-Leu- (SEQ ID NO:579)
Asn-Pro-<u>Glu</u>-Ser-Lys-Ala-Ile-<u>Lys</u>-Asn-Leu-Leu-Lys-(OH)NH₂ b427) RNH-Val-Pro-Leu-Xaa₃-Arg-Thr-Val-Arg-Xaa₁-Thr-Xaa₂-Ile-Ser-Xaa₄-[linker]-Leu- (SEQ ID NO:580)
Asn-Pro-<u>Glu</u>-Ser-Lys-Ala-Ile-<u>Lys</u>-Asn-Leu-Leu-Lys-(OH)NH₂ b428) RNH-Val-Pro-Leu-Ser-Xaa₃-Thr-Val-Arg-Xaa₁-Thr-Xaa₂-Ile-Ser-Xaa₄-[linker]-Leu- (SEQ ID NO:581)
Asn-Pro-<u>Glu</u>-Ser-Lys-Ala-Ile-<u>Lys</u>-Asn-Leu-Leu-Lys-(OH)NH₂ b429) RNH-Val-Pro-Leu-Ser-Arg-Xaa₃-Val-Arg-Xaa₁-Thr-Xaa₂-Ile-Ser-Xaa₄-[linker]-Leu- (SEQ ID NO:582)
Asn-Pro-<u>Glu</u>-Ser-Lys-Ala-Ile-<u>Lys</u>-Asn-Leu-Leu-Lys-(OH)NH₂ b430) RNH-Val-Pro-Leu-Ser-Arg-Thr-Xaa₃-Arg-Xaa₁-Thr-Xaa₂-Ile-Ser-Xaa₄-[linker]-Leu- (SEQ ID NO:583)
Asn-Pro-<u>Glu</u>-Ser-Lys-Ala-Ile-<u>Lys</u>-Asn-Leu-Leu-Lys-(OH)NH₂ b431) RNH-Val-Pro-Leu-Ser-Arg-Thr-Val-Xaa₃-Xaa₁-Thr-Xaa₂-Ile-Ser-Xaa₄-[linker]-Leu- (SEQ ID NO:584)
Asn-Pro-<u>Glu</u>-Ser-Lys-Ala-Ile-<u>Lys</u>-Asn-Leu-Leu-Lys-(OH)NH₂

IP-10-(1–17)-[linker]-IP-10-(54–66)-cyclic(Glu57–Lys62) acid or amide b432) RNH-Val-Pro-Leu-Ser-Arg-Thr-Val-Arg-Cys-Thr-Cys-Ile-Ser-Ile-Ser-Asn-Gln- (SEQ ID NO:585)
[linker]-Leu-Asn-Pro-<u>Glu</u>-Ser-Lys-Ala-Ile-<u>Lys</u>-Asn-Leu-Leu-Lys-(OH)NH₂ b433) RNH-Xaa₃-Pro-Leu-Ser-Arg-Thr-Val-Arg-Xaa₁-Thr-Xaa₂-Ile-Ser-Ile-Ser-Asn-Gln- (SEQ ID NO:586)
[linker]-Leu-Asn-Pro-<u>Glu</u>-Ser-Lys-Ala-Ile-<u>Lys</u>-Asn-Leu-Leu-Lys-(OH)NH₂ b434) RNH-Val-Xaa₃-Leu-Ser-Arg-Thr-Val-Arg-Xaa₁-Thr-Xaa₂-Ile-Ser-Ile-Ser-Asn-Gln- (SEQ ID NO:587)
[linker]-Leu-Asn-Pro-<u>Glu</u>-Ser-Lys-Ala-Ile-<u>Lys</u>-Asn-Leu-Leu-Lys-(OH)NH₂ b435) RNH-Val-Pro-Xaa₃-Ser-Arg-Thr-Val-Arg-Xaa₁-Thr-Xaa₂-Ile-Ser-Ile-Ser-Asn-Gln- (SEQ ID NO:588)
[linker]-Leu-Asn-Pro-<u>Glu</u>-Ser-Lys-Ala-Ile-<u>Lys</u>-Asn-Leu-Leu-Lys-(OH)NH₂ b436) RNH-Val-Pro-Leu-Xaa₃-Arg-Thr-Val-Arg-Xaa₁-Thr-Xaa₂-Ile-Ser-Ile-Ser-Asn-Gln- (SEQ ID NO:589)
[linker]-Leu-Asn-Pro-<u>Glu</u>-Ser-Lys-Ala-Ile-<u>Lys</u>-Asn-Leu-Leu-Lys-(OH)NH₂ b437) RNH-Val-Pro-Leu-Ser-Xaa₃-Thr-Val-Arg-Xaa₁-Thr-Xaa₂-Ile-Ser-Ile-Ser-Asn-Gln- (SEQ ID NO:590)
[linker]-Leu-Asn-Pro-<u>Glu</u>-Ser-Lys-Ala-Ile-<u>Lys</u>-Asn-Leu-Leu-Lys-(OH)NH₂ b438) RNH-Val-Pro-Leu-Ser-Arg-Xaa₃-Val-Arg-Xaa₁-Thr-Xaa₂-Ile-Ser-Ile-Ser-Asn-Gln- (SEQ ID NO:591)
[linker]-Leu-Asn-Pro-<u>Glu</u>-Ser-Lys-Ala-Ile-<u>Lys</u>-Asn-Leu-Leu-Lys-(OH)NH₂ b439) RNH-Val-Pro-Leu-Ser-Arg-Thr-Xaa₃-Arg-Xaa₁-Thr-Xaa₂-Ile-Ser-Ile-Ser-Asn-Gln- (SEQ ID NO:592)
[linker]-Leu-Asn-Pro-<u>Glu</u>-Ser-Lys-Ala-Ile-<u>Lys</u>-Asn-Leu-Leu-Lys-(OH)NH₂ b440) RNH-Val-Pro-Leu-Ser-Arg-Thr-Val-Xaa₃-Xaa₁-Thr-Xaa₂-Ile-Ser-Ile-Ser-Asn-Gln- (SEQ ID NO:593)
[linker]-Leu-Asn-Pro-<u>Glu</u>-Ser-Lys-Ala-Ile-<u>Lys</u>-Asn-Leu-Leu-Lys-(OH)NH₂ b441) RNH-Val-Pro-Leu-Ser-Arg-Thr-Val-Arg-Cys-Thr-Cys-Xaa₄-Ser-Ile-Ser-Asn-Gln- (SEQ ID NO:594)
[linker]-Leu-Asn-Pro-<u>Glu</u>-Ser-Lys-Ala-Ile-<u>Lys</u>-Asn-Leu-Leu-Lys-(OH)NH₂ b442) RNH-Xaa₃-Pro-Leu-Ser-Arg-Thr-Val-Arg-Xaa₁-Thr-Xaa₂-Xaa₄-Ser-Ile-Ser-Asn-Gln- (SEQ ID NO:595)
[linker]-Leu-Asn-Pro-<u>Glu</u>-Ser-Lys-Ala-Ile-<u>Lys</u>-Asn-Leu-Leu-Lys-(OH)NH₂ b443) RNH-Val-Xaa₃-Leu-Ser-Arg-Thr-Val-Arg-Xaa₁-Thr-Xaa₂-Xaa₄-Ser-Ile-Ser-Asn-Gln- (SEQ ID NO:596)
[linker]-Leu-Asn-Pro-<u>Glu</u>-Ser-Lys-Ala-Ile-<u>Lys</u>-Asn-Leu-Leu-Lys-(OH)NH₂ b444) RNH-Val-Pro-Xaa₃-Ser-Arg-Thr-Val-Arg-Xaa₁-Thr-Xaa₂-Xaa₄-Ser-Ile-Ser-Asn-Gln- (SEQ ID NO:597)
[linker]-Leu-Asn-Pro-<u>Glu</u>-Ser-Lys-Ala-Ile-<u>Lys</u>-Asn-Leu-Leu-Lys-(OH)NH₂ b445) RNH-Val-Pro-Leu-Xaa₃-Arg-Thr-Val-Arg-Xaa₁-Thr-Xaa₂-Xaa₄-Ser-Ile-Ser-Asn-Gln- (SEQ ID NO:598)
[linker]-Leu-Asn-Pro-<u>Glu</u>-Ser-Lys-Ala-Ile-<u>Lys</u>-Asn-Leu-Leu-Lys-(OH)NH₂ b446) RNH-Val-Pro-Leu-Ser-Xaa₃-Thr-Val-Arg-Xaa₁-Thr-Xaa₂-Xaa₄-Ser-Ile-Ser-Asn-Gln- (SEQ ID NO:599)
[linker]-Leu-Asn-Pro-<u>Glu</u>-Ser-Lys-Ala-Ile-<u>Lys</u>-Asn-Leu-Leu-Lys-(OH)NH₂ b447) RNH-Val-Pro-Leu-Ser-Arg-Xaa₃-Val-Arg-Xaa₁-Thr-Xaa₂-Xaa₄-Ser-Ile-Ser-Asn-Gln- (SEQ ID NO:600)
[linker]-Leu-Asn-Pro-<u>Glu</u>-Ser-Lys-Ala-Ile-<u>Lys</u>-Asn-Leu-Leu-Lys-(OH)NH₂ b448) RNH-Val-Pro-Leu-Ser-Arg-Thr-Xaa₃-Arg-Xaa₁-Thr-Xaa₂-Xaa₄-Ser-Ile-Ser-Asn-Gln- (SEQ ID NO:601)
[linker]-Leu-Asn-Pro-<u>Glu</u>-Ser-Lys-Ala-Ile-<u>Lys</u>-Asn-Leu-Leu-Lys-(OH)NH₂ b449) RNH-Val-Pro-Leu-Ser-Arg-Thr-Val-Xaa₃-Xaa₁-Thr-Xaa₂-Xaa₄-Ser-Ile-Ser-Asn-Gln- (SEQ ID NO:602)
[linker]-Leu-Asn-Pro-<u>Glu</u>-Ser-Lys-Ala-Ile-<u>Lys</u>-Asn-Leu-Leu-Lys-(OH)NH₂ b450) RNH-Val-Pro-Leu-Ser-Arg-Thr-Val-Arg-Cys-Thr-Cys-Ile-Xaa₄-Ile-Ser-Asn-Gln- (SEQ ID NO:603)
[linker]-Leu-Asn-Pro-<u>Glu</u>-Ser-Lys-Ala-Ile-<u>Lys</u>-Asn-Leu-Leu-Lys-(OH)NH₂ b451) RNH-Xaa₃-Pro-Leu-Ser-Arg-Thr-Val-Arg-Xaa₁-Thr-Xaa₂-Ile-Xaa₄-Ile-Ser-Asn-Gln- (SEQ ID NO:604)
[linker]-Leu-Asn-Pro-<u>Glu</u>-Ser-Lys-Ala-Ile-<u>Lys</u>-Asn-Leu-Leu-Lys-(OH)NH₂

```
b452)  RNH-Val-Xaa₃-Leu-Ser-Arg-Thr-Val-Arg-Xaa₁-Thr-Xaa₂-Ile-Xaa₄-Ile-Ser-Asn-Gln-        (SEQ ID NO:605)
       [linker]-Leu-Asn-Pro-Glu-Ser-Lys-Ala-Ile-Lys-Asn-Leu-Leu-Lys-(OH)NH₂ b453)  RNH-Val-Pro-Xaa₃-Ser-Arg-Thr-Val-Arg-Xaa₁-Thr-Xaa₂-Ile-Xaa₄-Ile-Ser-Asn-Gln-        (SEQ ID NO:606)
       [linker]-Leu-Asn-Pro-Glu-Ser-Lys-Ala-Ile-Lys-Asn-Leu-Leu-Lys-(OH)NH₂ b454)  RNH-Val-Pro-Leu-Xaa₃-Arg-Thr-Val-Arg-Xaa₁-Thr-Xaa₂-Ile-Xaa₄-Ile-Ser-Asn-Gln-        (SEQ ID NO:607)
       [linker]-Leu-Asn-Pro-Glu-Ser-Lys-Ala-Ile-Lys-Asn-Leu-Leu-Lys-(OH)NH₂ b455)  RNH-Val-Pro-Leu-Ser-Xaa₃-Thr-Val-Arg-Xaa₁-Thr-Xaa₂-Ile-Xaa₄-Ile-Ser-Asn-Gln-        (SEQ ID NO:608)
       [linker]-Leu-Asn-Pro-Glu-Ser-Lys-Ala-Ile-Lys-Asn-Leu-Leu-Lys-(OH)NH₂ b456)  RNH-Val-Pro-Leu-Ser-Arg-Xaa₃-Val-Arg-Xaa₁-Thr-Xaa₂-Ile-Xaa₄-Ile-Ser-Asn-Gln-        (SEQ ID NO:609)
       [linker]-Leu-Asn-Pro-Glu-Ser-Lys-Ala-Ile-Lys-Asn-Leu-Leu-Lys-(OH)NH₂ b457)  RNH-Val-Pro-Leu-Ser-Arg-Thr-Xaa₃-Arg-Xaa₁-Thr-Xaa₂-Ile-Xaa₄-Ile-Ser-Asn-Gln-        (SEQ ID NO:610)
       [linker]-Leu-Asn-Pro-Glu-Ser-Lys-Ala-Ile-Lys-Asn-Leu-Leu-Lys-(OH)NH₂ b458)  RNH-Val-Pro-Leu-Ser-Arg-Thr-Val-Xaa₃-Xaa₁-Thr-Xaa₂-Ile-Xaa₄-Ile-Ser-Asn-Gln-        (SEQ ID NO:611)
       [linker]-Leu-Asn-Pro-Glu-Ser-Lys-Ala-Ile-Lys-Asn-Leu-Leu-Lys-(OH)NH₂ b459)  RNH-Val-Pro-Leu-Ser-Arg-Thr-Val-Arg-Cys-Thr-Cys-Ile-Ser-Xaa₄-Ser-Asn-Gln-           (SEQ ID NO:612)
       [linker]-Leu-Asn-Pro-Glu-Ser-Lys-Ala-Ile-Lys-Asn-Leu-Leu-Lys-(OH)NH₂ b460)  RNH-Xaa₃-Pro-Leu-Ser-Arg-Thr-Val-Arg-Xaa₁-Thr-Xaa₂-Ile-Ser-Xaa₄-Ser-Asn-Gln-        (SEQ ID NO:613)
       [linker]-Leu-Asn-Pro-Glu-Ser-Lys-Ala-Ile-Lys-Asn-Leu-Leu-Lys-(OH)NH₂ b461)  RNH-Val-Xaa₃-Leu-Ser-Arg-Thr-Val-Arg-Xaa₁-Thr-Xaa₂-Ile-Ser-Xaa₄-Ser-Asn-Gln-        (SEQ ID NO:614)
       [linker]-Leu-Asn-Pro-Glu-Ser-Lys-Ala-Ile-Lys-Asn-Leu-Leu-Lys-(OH)NH₂ b462)  RNH-Val-Pro-Xaa₃-Ser-Arg-Thr-Val-Arg-Xaa₁-Thr-Xaa₂-Ile-Ser-Xaa₄-Ser-Asn-Gln-        (SEQ ID NO:615)
       [linker]-Leu-Asn-Pro-Glu-Ser-Lys-Ala-Ile-Lys-Asn-Leu-Leu-Lys-(OH)NH₂ b463)  RNH-Val-Pro-Leu-Xaa₃-Arg-Thr-Val-Arg-Xaa₁-Thr-Xaa₂-Ile-Ser-Xaa₄-Ser-Asn-Gln-        (SEQ ID NO:616)
       [linker]-Leu-Asn-Pro-Glu-Ser-Lys-Ala-Ile-Lys-Asn-Leu-Leu-Lys-(OH)NH₂ b464)  RNH-Val-Pro-Leu-Ser-Xaa₃-Thr-Val-Arg-Xaa₁-Thr-Xaa₂-Ile-Ser-Xaa₄-Ser-Asn-Gln-        (SEQ ID NO:617)
       [linker]-Leu-Asn-Pro-Glu-Ser-Lys-Ala-Ile-Lys-Asn-Leu-Leu-Lys-(OH)NH₂ b465)  RNH-Val-Pro-Leu-Ser-Arg-Xaa₃-Val-Arg-Xaa₁-Thr-Xaa₂-Ile-Ser-Xaa₄-Ser-Asn-Gln-        (SEQ ID NO:618)
       [linker]-Leu-Asn-Pro-Glu-Ser-Lys-Ala-Ile-Lys-Asn-Leu-Leu-Lys-(OH)NH₂ b466)  RNH-Val-Pro-Leu-Ser-Arg-Thr-Xaa₃-Arg-Xaa₁-Thr-Xaa₂-Ile-Ser-Xaa₄-Ser-Asn-Gln-        (SEQ ID NO:619)
       [linker]-Leu-Asn-Pro-Glu-Ser-Lys-Ala-Ile-Lys-Asn-Leu-Leu-Lys-(OH)NH₂ b467)  RNH-Val-Pro-Leu-Ser-Arg-Thr-Val-Xaa₃-Xaa₁-Thr-Xaa₂-Ile-Ser-Xaa₄-Ser-Asn-Gln-        (SEQ ID NO:620)
       [linker]-Leu-Asn-Pro-Glu-Ser-Lys-Ala-Ile-Lys-Asn-Leu-Leu-Lys-(OH)NH₂ b468)  RNH-Val-Pro-Leu-Ser-Arg-Thr-Val-Arg-Cys-Thr-Cys-Ile-Ser-Xaa₄-Gln-                   (SEQ ID NO:621)
       [linker]-Leu-Asn-Pro-Glu-Ser-Lys-Ala-Ile-Lys-Asn-Leu-Leu-Lys-(OH)NH₂ b469)  RNH-Xaa₃-Pro-Leu-Ser-Arg-Thr-Val-Arg-Xaa₁-Thr-Xaa₂-Ile-Ser-Ile-Ser-Xaa₄-Gln-        (SEQ ID NO:622)
       [linker]-Leu-Asn-Pro-Glu-Ser-Lys-Ala-Ile-Lys-Asn-Leu-Leu-Lys-(OH)NH₂ b470)  RNH-Val-Xaa₃-Leu-Ser-Arg-Thr-Val-Arg-Xaa₁-Thr-Xaa₂-Ile-Ser-Ile-Ser-Xaa₄-Gln-        (SEQ ID NO:623)
       [linker]-Leu-Asn-Pro-Glu-Ser-Lys-Ala-Ile-Lys-Asn-Leu-Leu-Lys-(OH)NH₂ b471)  RNH-Val-Pro-Xaa₃-Ser-Arg-Thr-Val-Arg-Xaa₁-Thr-Xaa₂-Ile-Ser-Ile-Ser-Xaa₄-Gln-        (SEQ ID NO:624)
       [linker]-Leu-Asn-Pro-Glu-Ser-Lys-Ala-Ile-Lys-Asn-Leu-Leu-Lys-(OH)NH₂ b472)  RNH-Val-Pro-Leu-Xaa₃-Arg-Thr-Val-Arg-Xaa₁-Thr-Xaa₂-Ile-Ser-Ile-Ser-Xaa₄-Gln-        (SEQ ID NO:625)
       [linker]-Leu-Asn-Pro-Glu-Ser-Lys-Ala-Ile-Lys-Asn-Leu-Leu-Lys-(OH)NH₂ b473)  RNH-Val-Pro-Leu-Ser-Xaa₃-Thr-Val-Arg-Xaa₁-Thr-Xaa₂-Ile-Ser-Ile-Ser-Xaa₄-Gln-        (SEQ ID NO:626)
       [linker]-Leu-Asn-Pro-Glu-Ser-Lys-Ala-Ile-Lys-Asn-Leu-Leu-Lys-(OH)NH₂ b474)  RNH-Val-Pro-Leu-Ser-Arg-Xaa₃-Val-Arg-Xaa₁-Thr-Xaa₂-Ile-Ser-Ile-Ser-Xaa₄-Gln-        (SEQ ID NO:627)
       [linker]-Leu-Asn-Pro-Glu-Ser-Lys-Ala-Ile-Lys-Asn-Leu-Leu-Lys-(OH)NH₂ b475)  RNH-Val-Pro-Leu-Ser-Arg-Thr-Xaa₃-Arg-Xaa₁-Thr-Xaa₂-Ile-Ser-Ile-Ser-Xaa₄-Gln-        (SEQ ID NO:628)
       [linker]-Leu-Asn-Pro-Glu-Ser-Lys-Ala-Ile-Lys-Asn-Leu-Leu-Lys-(OH)NH₂ b476)  RNH-Val-Pro-Leu-Ser-Arg-Thr-Val-Xaa₃-Xaa₁-Thr-Xaa₂-Ile-Ser-Ile-Ser-Xaa₄-Gln-        (SEQ ID NO:629)
       [linker]-Leu-Asn-Pro-Glu-Ser-Lys-Ala-Ile-Lys-Asn-Leu-Leu-Lys-(OH)NH₂ b477)  RNH-Val-Pro-Leu-Ser-Arg-Thr-Val-Arg-Cys-Thr-Cys-Ile-Ser-Ile-Ser--Gln-Xaa₄-          (SEQ ID NO:630)
       [linker]-Leu-Asn-Pro-Glu-Ser-Lys-Ala-Ile-Lys-Asn-Leu-Leu-Lys-(OH)NH₂
```

-continued

| | | |
|---|---|---|
| b478) | RNH-Xaa₃-Pro-Leu-Ser-Arg-Thr-Val-Arg-Xaa₁-Thr-Xaa₂-Ile-Ser-Ile-Ser-Gln-Xaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:631) |
| b479) | RNH-Val-Xaa₃-Leu-Ser-Arg-Thr-Val-Arg-Xaa₁-Thr-Xaa₂-Ile-Ser-Ile-Ser-GlnXaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:632) |
| b480) | RNH-Val-Pro-Xaa₃-Ser-Arg-Thr-Val-Arg-Xaa₁-Thr-Xaa₂-Ile-Ser-Ile-Ser-GlnXaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:633) |
| b481) | RNH-Val-Pro-Leu-Xaa₃-Arg-Thr-Val-Arg-Xaa₁-Thr-Xaa₂-Ile-Ser-Ile-Ser-GlnXaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:634) |
| b482) | RNH-Val-Pro-Leu-Ser-Xaa₃-Thr-Val-Arg-Xaa₁-Thr-Xaa₂-Ile-Ser-Ile-Ser-GlnXaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:635) |
| b483) | RNH-Val-Pro-Leu-Ser-Arg-Xaa₃-Val-Arg-Xaa₁-Thr-Xaa₂-Ile-Ser-Ile-Ser-Gln-Xaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:636) |
| b484) | RNH-Val-Pro-Leu-Ser-Arg-Thr-Xaa₃-Arg-Xaa₁-Thr-Xaa₂-Ile-Ser-Ile-Ser-Gln-Xaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:637) |
| b485) | RNH-Val-Pro-Leu-Ser-Arg-Thr-Val-Xaa₃-Xaa₁-Thr-Xaa₂-Ile-Ser-Ile-Ser-Gln-Xaa₄-<br>[linker]-Leu-Asn-Pro-<u>Glu</u>-Ser-Lys-Ala-Ile-<u>Lys</u>-Asn-Leu-Leu-Lys-(OH)NH₂ | (SEQ ID NO:638) |

In some embodiments IP-10 analogs were cyclized by etherification between Lys66 and Ser69 (underlined residues are cyclized).

IP-10(1–14)-[linker]-IP-10-(59–71)-cyclic(Lys66–Ser69) acid or amide

| | | |
|---|---|---|
| b486) | RNH-Val-Pro-Leu-Ser-Arg-Thr-Val-Arg-Cys-Thr-Cys-Ile-Ser-Ile-[linker]-Lys-Ala-<br>Ile-Lys-Asn-Leu-Leu-<u>Lys</u>-Ala-Val-<u>Ser</u>-Lys-Glu-(OH)NH₂ | (SEQ ID NO:639) |
| b487) | RNH-Xaa₃-Pro-Leu-Ser-Arg-Thr-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:640) |
| b488) | RNH-Val-Xaa₃-Leu-Ser-Arg-Thr-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:641) |
| b489) | RNH-Val-Pro-Xaa₃-Ser-Arg-Thr-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:642) |
| b490) | RNH-Val-Pro-Leu-Xaa₃-Arg-Thr-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:643) |
| b491) | RNH-Val-Pro-Leu-Ser-Xaa₃-Thr-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:644) |
| b492) | RNH-Val-Pro-Leu-Ser-Arg-Xaa₃-Val-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:645) |
| b493) | RNH-Val-Pro-Leu-Ser-Arg-Thr-Xaa₃-Arg-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:646) |
| b494) | RNH-Val-Pro-Leu-Ser-Arg-Thr-Val-Xaa₃-Xaa₁-Thr-Xaa₂-Ile-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:647) |
| b495) | RNH-Val-Pro-Leu-Ser-Arg-Thr-Val-Arg-Cys-Thr-Cys-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:648) |
| b496) | RNH-Xaa₃-Pro-Leu-Ser-Arg-Thr-Val-Arg-Xaa₁-Thr-Xaa₂-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:649) |
| b497) | RNH-Val-Xaa₃-Leu-Ser-Arg-Thr-Val-Arg-Xaa₁-Thr-Xaa₂-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:650) |
| b498) | RNH-Val-Pro-Xaa₃-Ser-Arg-Thr-Val-Arg-Xaa₁-Thr-Xaa₂-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:651) |
| b499) | RNH-Val-Pro-Leu-Xaa₃-Arg-Thr-Val-Arg-Xaa₁-Thr-Xaa₂-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:652) |
| b500) | RNH-Val-Pro-Leu-Ser-Xaa₃-Thr-Val-Arg-Xaa₁-Thr-Xaa₂-Xaa₄-Ser-Ile-[linker]-Lys-<br>Ala-Ile-Lys-Asn-Leu-Leu-<u>Lys</u>-Ala-Val-<u>Ser</u>-Lys-Glu-(OH)NH₂ | (SEQ ID NO:653) |

-continued b501) RNH-Val-Pro-Leu-Ser-Arg-Xaa₃-Val-Arg-Xaa₁-Thr-Xaa₂-Xaa₄-Ser-Ile-[linker]-Lys- (SEQ ID NO:654)
Ala-Ile-Lys-Asn-Leu-Leu-<u>Lys</u>-Ala-Val-<u>Ser</u>-Lys-Glu-(OH)NH₂ b502) RNH-Val-Pro-Leu-Ser-Arg-Thr-Xaa₃-Arg-Xaa₁-Thr-Xaa₂-Xaa₄-Ser-Ile-[linker]-Lys- (SEQ ID NO:655)
Ala-Ile-Lys-Asn-Leu-Leu-<u>Lys</u>-Ala-Val-<u>Ser</u>-Lys-Glu-(OH)NH₂ b503) RNH-Val-Pro-Leu-Ser-Arg-Thr-Val-Xaa₃-Xaa₁-Thr-Xaa₂-Xaa₄-Ser-Ile-[linker]-Lys- (SEQ ID NO:656)
Ala-Ile-Lys-Asn-Leu-Leu-<u>Lys</u>-Ala-Val-<u>Ser</u>-Lys-Glu-(OH)NH₂ b504) RNH-Val-Pro-Leu-Ser-Arg-Thr-Val-Arg-Cys-Thr-Cys-Ile-Xaa₄-Ile-[linker]-Lys-Ala- (SEQ ID NO:657)
Ile-Lys-Asn-Leu-Leu-<u>Lys</u>-Ala-Val-<u>Ser</u>-Lys-Glu-(OH)NH₂ b505) RNH-Xaa₃-Pro-Leu-Ser-Arg-Thr-Val-Arg-Xaa₁-Thr-Xaa₂-Ile-Xaa₄-Ile-[linker]-Lys- (SEQ ID NO:658)
Ala-Ile-Lys-Asn-Leu-Leu-<u>Lys</u>-Ala-Val-<u>Ser</u>-Lys-Glu-(OH)NH₂ b506) RNH-Val-Xaa₃-Leu-Ser-Arg-Thr-Val-Arg-Xaa₁-Thr-Xaa₂-Ile-Xaa₄-Ile-[linker]-Lys- (SEQ ID NO:659)
Ala-Ile-Lys-Asn-Leu-Leu-<u>Lys</u>-Ala-Val-<u>Ser</u>-Lys-Glu-(OH)NH₂ b507) RNH-Val-Pro-Xaa₃-Ser-Arg-Thr-Val-Arg-Xaa₁-Thr-Xaa₂-Ile-Xaa₄-Ile-[linker]-Lys- (SEQ ID NO:660)
Ala-Ile-Lys-Asn-Leu-Leu-<u>Lys</u>-Ala-Val-<u>Ser</u>-Lys-Glu-(OH)NH₂ b508) RNH-Val-Pro-Leu-Xaa₃-Arg-Thr-Val-Arg-Xaa₁-Thr-Xaa₂-Ile-Xaa₄-Ile-[linker]-Lys- (SEQ ID NO:661)
Ala-Ile-Lys-Asn-Leu-Leu-<u>Lys</u>-Ala-Val-<u>Ser</u>-Lys-Glu-(OH)NH₂ b509) RNH-Val-Pro-Leu-Ser-Xaa₃-Thr-Val-Arg-Xaa₁-Thr-Xaa₂-Ile-Xaa₄-Ile-[linker]-Lys- (SEQ ID NO:662)
Ala-Ile-Lys-Asn-Leu-Leu-<u>Lys</u>-Ala-Val-<u>Ser</u>-Lys-Glu-(OH)NH₂ b510) RNH-Val-Pro-Leu-Ser-Arg-Xaa₃-Val-Arg-Xaa₁-Thr-Xaa₂-Ile-Xaa₄-Ile-[linker]-Lys- (SEQ ID NO:663)
Ala-Ile-Lys-Asn-Leu-Leu-<u>Lys</u>-Ala-Val-<u>Ser</u>-Lys-Glu-(OH)NH₂ b511) RNH-Val-Pro-Leu-Ser-Arg-Thr-Xaa₃-Arg-Xaa₁-Thr-Xaa₂-Ile-Xaa₄-Ile-[linker]-Lys- (SEQ ID NO:664)
Ala-Ile-Lys-Asn-Leu-Leu-<u>Lys</u>-Ala-Val-<u>Ser</u>-Lys-Glu-(OH)NH₂ b512) RNH-Val-Pro-Leu-Ser-Arg-Thr-Val-Xaa₃-Xaa₁-Thr-Xaa₂-Ile-Xaa₄-Ile-[linker]-Lys- (SEQ ID NO:665)
Ala-Ile-Lys-Asn-Leu-Leu-<u>Lys</u>-Ala-Val-<u>Ser</u>-Lys-Glu-(OH)NH₂ b513) RNH-Val-Pro-Leu-Ser-Arg-Thr-Val-Arg-Cys-Thr-Cys-Ile-Ser-Xaa₄-[linker]-Lys- (SEQ ID NO:666)
Ala-Ile-Lys-Asn-Leu-Leu-<u>Lys</u>-Ala-Val-<u>Ser</u>-Lys-Glu-(OH)NH₂ b514) RNH-Xaa₃-Pro-Leu-Ser-Arg-Thr-Val-Arg-Xaa₁-Thr-Xaa₂-Ile-Ser-Xaa₄-[linker]-Lys- (SEQ ID NO:667)
Ala-Ile-Lys-Asn-Leu-Leu-<u>Lys</u>-Ala-Val-<u>Ser</u>-Lys-Glu-(OH)NH₂ b515) RNH-Val-Xaa₃-Leu-Ser-Arg-Thr-Val-Arg-Xaa₁-Thr-Xaa₂-Ile-Ser-Xaa₄-[linker]-Lys- (SEQ ID NO:668)
Ala-Ile-Lys-Asn-Leu-Leu-<u>Lys</u>-Ala-Val-<u>Ser</u>-Lys-Glu-(OH)NH₂ b516) RNH-Val-Pro-Xaa₃-Ser-Arg-Thr-Val-Arg-Xaa₁-Thr-Xaa₂-Ile-Ser-Xaa₄-[linker]-Lys- (SEQ ID NO:669)
Ala-Ile-Lys-Asn-Leu-Leu-<u>Lys</u>-Ala-Val-<u>Ser</u>-Lys-Glu-(OH)NH₂ b517) RNH-Val-Pro-Leu-Xaa₃-Arg-Thr-Val-Arg-Xaa₁-Thr-Xaa₂-Ile-Ser-Xaa₄-[linker]-Lys- (SEQ ID NO:670)
Ala-Ile-Lys-Asn-Leu-Leu-<u>Lys</u>-Ala-Val-<u>Ser</u>-Lys-Glu-(OH)NH₂ b518) RNH-Val-Pro-Leu-Ser-Xaa₃-Thr-Val-Arg-Xaa₁-Thr-Xaa₂-Ile-Ser-Xaa₄-[linker]-Lys- (SEQ ID NO:671)
Ala-Ile-Lys-Asn-Leu-Leu-<u>Lys</u>-Ala-Val-<u>Ser</u>-Lys-Glu-(OH)NH₂ b519) RNH-Val-Pro-Leu-Ser-Arg-Xaa₃-Val-Arg-Xaa₁-Thr-Xaa₂-Ile-Ser-Xaa₄-[linker]-Lys- (SEQ ID NO:672)
Ala-Ile-Lys-Asn-Leu-Leu-<u>Lys</u>-Ala-Val-<u>Ser</u>-Lys-Glu-(OH)NH₂ b520) RNH-Val-Pro-Leu-Ser-Arg-Thr-Xaa₃-Arg-Xaa₁-Thr-Xaa₂-Ile-Ser-Xaa₄-[linker]-Lys- (SEQ ID NO:673)
Ala-Ile-Lys-Asn-Leu-Leu-<u>Lys</u>-Ala-Val-<u>Ser</u>-Lys-Glu-(OH)NH₂ b521) RNH-Val-Pro-Leu-Ser-Arg-Thr-Val-Xaa₃-Xaa₁-Thr-Xaa₂-Ile-Ser-Xaa₄-[linker]-Lys- (SEQ ID NO:674)
Ala-Ile-Lys-Asn-Leu-Leu-<u>Lys</u>-Ala-Val-<u>Ser</u>-Lys-Glu-(OH)NH₂

IP-10-(1–17)-[linker]-IP-10-(59–71)-cyclic(Lys66–Ser69) acid or amide b522) RNH-Val-Pro-Leu-Ser-Arg-Thr-Val-Arg-Cys-Thr-Cys-Ile-Ser-Ile-Ser-Asn-Gln- (SEQ ID NO:675)
[linker]-Lys-Ala-Ile-Lys-Asn-Leu-Leu-<u>Lys</u>-Ala-Val-<u>Ser</u>-Lys-Glu-(OH)NH₂ b523) RNH-Xaa₃-Pro-Leu-Ser-Arg-Thr-Val-Arg-Xaa₁-Thr-Xaa₂-Ile-Ser-Ile-Ser-Asn-Gln- (SEQ ID NO:676)
[linker]-Lys-Ala-Ile-Lys-Asn-Leu-Leu-<u>Lys</u>-Ala-Val-<u>Ser</u>-Lys-Glu-(OH)NH₂ b524) RNH-Val-Xaa₃-Leu-Ser-Arg-Thr-Val-Arg-Xaa₁-Thr-Xaa₂-Ile-Ser-Ile-Ser-Asn-Gln- (SEQ ID NO:677)
[linker]-Lys-Ala-Ile-Lys-Asn-Leu-Leu-<u>Lys</u>-Ala-Val-<u>Ser</u>-Lys-Glu-(OH)NH₂ b525) RNH-Val-Pro-Xaa₃-Ser-Arg-Thr-Val-Arg-Xaa₁-Thr-Xaa₂-Ile-Ser-Ile-Ser-Asn-Gln- (SEQ ID NO:678)
[linker]-Lys-Ala-Ile-Lys-Asn-Leu-Leu-<u>Lys</u>-Ala-Val-<u>Ser</u>-Lys-Glu-(OH)NH₂ b526) RNH-Val-Pro-Leu-Xaa₃-Arg-Thr-Val-Arg-Xaa₁-Thr-Xaa₂-Ile-Ser-Ile-Ser-Asn-Gln- (SEQ ID NO:679)
[linker]-Lys-Ala-Ile-Lys-Asn-Leu-Leu-<u>Lys</u>-Ala-Val-<u>Ser</u>-Lys-Glu-(OH)NH₂

-continued

| | | |
|---|---|---|
| b527) | RNH-Val-Pro-Leu-Ser-Xaa<sub>3</sub>-Thr-Val-Arg-Xaa<sub>1</sub>-Thr-Xaa<sub>2</sub>-Ile-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:680) |
| b528) | RNH-Val-Pro-Leu-Ser-Arg-Xaa<sub>3</sub>-Val-Arg-Xaa<sub>1</sub>-Thr-Xaa<sub>2</sub>-Ile-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:681) |
| b529) | RNH-Val-Pro-Leu-Ser-Arg-Thr-Xaa<sub>3</sub>-Arg-Xaa<sub>1</sub>-Thr-Xaa<sub>2</sub>-Ile-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:682) |
| b530) | RNH-Val-Pro-Leu-Ser-Arg-Thr-Val-Xaa<sub>3</sub>-Xaa<sub>1</sub>-Thr-Xaa<sub>2</sub>-Ile-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:683) |
| b531) | RNH-Val-Pro-Leu-Ser-Arg-Thr-Val-Arg-Cys-Thr-Cys-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:684) |
| b532) | RNH-Xaa<sub>3</sub>-Pro-Leu-Ser-Arg-Thr-Val-Arg-Xaa<sub>1</sub>-Thr-Xaa<sub>2</sub>-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:685) |
| b533) | RNH-Val-Xaa<sub>3</sub>-Leu-Ser-Arg-Thr-Val-Arg-Xaa<sub>1</sub>-Thr-Xaa<sub>2</sub>-Xaa<sub>4</sub>Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:686) |
| b534) | RNH-Val-Pro-Xaa<sub>3</sub>-Ser-Arg-Thr-Val-Arg-Xaa<sub>1</sub>-Thr-Xaa<sub>2</sub>-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:687) |
| b535) | RNH-Val-Pro-Leu-Xaa<sub>3</sub>-Arg-Thr-Val-Arg-Xaa<sub>1</sub>-Thr-Xaa<sub>2</sub>-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:688) |
| b536) | RNH-Val-Pro-Leu-Ser-Xaa<sub>3</sub>-Thr-Val-Arg-Xaa<sub>1</sub>-Thr-Xaa<sub>2</sub>-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:689) |
| b537) | RNH-Val-Pro-Leu-Ser-Arg-Xaa<sub>3</sub>-Val-Arg-Xaa<sub>1</sub>-Thr-Xaa<sub>2</sub>-Xaa<sub>4</sub>-Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:690) |
| b538) | RNH-Val-Pro-Leu-Ser-Arg-Thr-Xaa<sub>3</sub>-Arg-Xaa<sub>1</sub>-Thr-Xaa<sub>2</sub>-Xaa<sub>4</sub>Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:691) |
| b539) | RNH-Val-Pro-Leu-Ser-Arg-Thr-Val-Xaa<sub>3</sub>-Xaa<sub>1</sub>-Thr-Xaa<sub>2</sub>-Xaa<sub>4</sub>Ser-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:692) |
| b540) | RNH-Val-Pro-Leu-Ser-Arg-Thr-Val-Arg-Cys-Thr-Cys-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:693) |
| b541) | RNH-Xaa<sub>3</sub>-Pro-Leu-Ser-Arg-Thr-Val-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:694) |
| b542) | RNH-Val-Xaa<sub>3</sub>-Leu-Ser-Arg-Thr-Val-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:695) |
| b543) | RNH-Val-Pro-Xaa<sub>3</sub>-Ser-Arg-Thr-Val-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:696) |
| b544) | RNH-Val-Pro-Leu-Xaa<sub>3</sub>-Arg-Thr-Val-Arg-Xaa<sub>1</sub>-Thr-Xaa<sub>2</sub>-Ile-Xaa<sub>4</sub>Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:697) |
| b545) | RNH-Val-Pro-Leu-Ser-Xaa<sub>3</sub>-Thr-Val-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:698) |
| b546) | RNH-Val-Pro-Leu-Ser-Arg-Xaa<sub>3</sub>-Val-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:699) |
| b547) | RNH-Val-Pro-Leu-Ser-Arg-Thr-Xaa<sub>3</sub>-Arg-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:700) |
| b548) | RNH-Val-Pro-Leu-Ser-Arg-Thr-Val-Xaa<sub>3</sub>-Xaa<sub>1</sub>-Thr-Xaa<sub>2</sub>-Ile-Xaa<sub>4</sub>-Ile-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO 701) |
| b549) | RNH-Val-Pro-Leu-Ser-Arg-Thr-Val-Arg-Cys-Thr-Cys-Ile-Ser-Xaa<sub>4</sub>-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:702) |
| b550) | RNH-Xaa<sub>3</sub>-Pro-Leu-Ser-Arg-Thr-Val-Arg-Xaa<sub>1</sub>-Thr-Xaa<sub>2</sub>-Ile-Ser-Xaa<sub>4</sub>-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:703) |
| b551) | RNH-Val-Xaa<sub>3</sub>-Leu-Ser-Arg-Thr-Val-Arg-Xaa<sub>1</sub>-Thr-Xaa<sub>2</sub>-Ile-Ser-Xaa<sub>4</sub>-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH<sub>2</sub> | (SEQ ID NO:704) |

-continued

| | | |
|---|---|---|
| b552) | RNH-Val-Pro-Xaa₃-Ser-Arg-Thr-Val-Arg-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:705) |
| b553) | RNH-Val-Pro-Leu-Xaa₃-Arg-Thr-Val-Arg-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:706) |
| b554) | RNH-Val-Pro-Leu-Ser-Xaa₃-Thr-Val-Arg-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:707) |
| b555) | RNH-Val-Pro-Leu-Ser-Arg-Xaa₃-Val-Arg-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:708) |
| b556) | RNH-Val-Pro-Leu-Ser-Arg-Thr-Xaa₃-Arg-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:709) |
| b557) | RNH-Val-Pro-Leu-Ser-Arg-Thr-Val-Xaa₃-Xaa₁-Thr-Xaa₂-Ile-Ser-Xaa₄-Ser-Asn-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:710) |
| b558) | RNH-Val-Pro-Leu-Ser-Arg-Thr-Val-Arg-Cys-Thr-Cys-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:711) |
| b559) | RNH-Xaa₃-Pro-Leu-Ser-Arg-Thr-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:712) |
| b560) | RNH-Val-Xaa₃-Leu-Ser-Arg-Thr-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:713) |
| b561) | RNH-Val-Pro-Xaa₃-Ser-Arg-Thr-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:714) |
| b562) | RNH-Val-Pro-Leu-Xaa₃-Arg-Thr-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:715) |
| b563) | RNH-Val-Pro-Leu-Ser-Xaa₃-Thr-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:716) |
| b564) | RNH-Val-Pro-Leu-Ser-Arg-Xaa₃-Val-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:717) |
| b565) | RNH-Val-Pro-Leu-Ser-Arg-Thr-Xaa₃-Arg-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:718) |
| b566) | RNH-Val-Pro-Leu-Ser-Arg-Thr-Val-Xaa₃-Xaa₁-Thr-Xaa₂-Ile-Ser-Ile-Ser-Xaa₄-Gln-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:719) |
| b567) | RNH-Val-Pro-Leu-Ser-Arg-Thr-Val-Arg-Cys-Thr-Cys-Ile-Ser-Ile-Ser-Gln-Xaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:720) |
| b568) | RNH-Xaa₃-Pro-Leu-Ser-Arg-Thr-Val-Arg-Xaa₁-Thr-Xaa₂-Ile-Ser-Ile-Ser-Gln-Xaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:721) |
| b569) | RNH-Val-Xaa₃-Leu-Ser-Arg-Thr-Val-Arg-Xaa₁-Thr-Xaa₂-Ile-Ser-Ile-Ser-GlnXaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:722) |
| b570) | RNH-Val-Pro-Xaa₃-Ser-Arg-Thr-Val-Arg-Xaa₁-Thr-Xaa₂-Ile-Ser-Ile-Ser-GlnXaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:723) |
| b571) | RNH-Val-Pro-Leu-Xaa₃-Arg-Thr-Val-Arg-Xaa₁-Thr-Xaa₂-Ile-Ser-Ile-Ser-GlnXaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:724) |
| b572) | RNH-Val-Pro-Leu-Ser-Xaa₃-Thr-Val-Arg-Xaa₁-Thr-Xaa₂-Ile-Ser-Ile-Ser-GlnXaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:725) |
| b573) | RNH-Val-Pro-Leu-Ser-Arg-Xaa₃-Val-Arg-Xaa₁-Thr-Xaa₂-Ile-Ser-Ile-Ser-Gln-Xaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:726) |
| b574) | RNH-Val-Pro-Leu-Ser-Arg-Thr-Xaa₃-Arg-Xaa₁-Thr-Xaa₂-Ile-Ser-Ile-Ser-Gln-Xaa₄-<br>[linker]-Lys-Ala-Ile-Lys-Asn-Leu-Leu-<u>Lys</u>-Ala-Val-<u>Ser</u>-Lys-Glu-(OH)NH₂ | (SEQ ID NO:727) |
| b575) | RNH-Val-Pro-Leu-Ser-Arg-Thr-Val-Xaa₃-Xaa₁-Thr-Xaa₂-Ile-<br>Ser-Ile-Ser-Gln-Xaa₄-[linker]-<br>Lys-Ala-Ile-Lys-Asn-Leu-Leu-<u>Lys</u>-Ala-Val-<u>Ser</u>-Lys-Glu-<br>(OH)NH₂ | (SEQ ID NO:728) |

In the above structures:
R is selected from the group consisting of hydrogen, alkyl, alkenyl, alkynyl, alkylcarbonyl, arylcarbonyl, aryl, PEG (polyethyleneglycol) and any other modifying group.

$Xaa_3$ is selected from the group consisting of L-Pro, D-Pro, P*, Btd and any L- or D-natural and non-natural amino acid.

Xaa₄ is selected from the group consisting of P*, Btd and any L- or D-natural amino acid and any non-natural amino acid.

P* is:

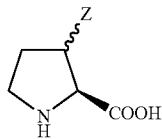

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, Orn to Asp. Moieties other than naturally occurring amino acids may also be substituted, such as Btd:

Btd* is:

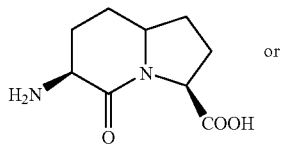

or

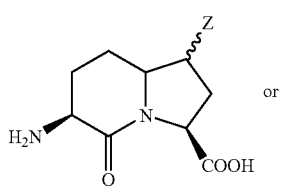

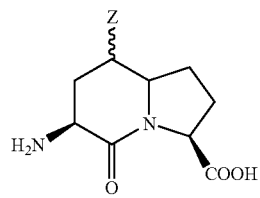

Z=hydrogen, alkyl, alkenyl, alkylcarbonyl, arylcarbonyl, aryl, aryl-hydroxy, and more Xaa₁ is selected from the group consisting of any L- or D-natural amino acid and any non-natural amino acid.

Xaa₂ is selected from the group consisting of any L- or D-natural amino acid and any non-natural amino acid.

The linker is a bifunctional group covalently attached to the N-terminal and C-terminal portions of the analog having the structure: H₂N-Z$_A$-COOH wherein Z$_A$ is selected from the group consisting of: (1) alkyl, alkenyl, aralkyl, alkynyl; (2) —(CH₂)$_n$— wherein n is an integer n=9 to 14; (3) any combination of four natural amino acids or non-natural amino acids; and (4) -(Gly)₄- (SEQ ID NO: 1640).

MIP-1α Compounds:

Preferred embodiments of linear MIP-1α analogs of the present invention corresponding to a portion of the N-terminal region of MIP-1α having the following sequence:

```
MIP-1α-(1-9) acid or amide
c1) RNH-Ser-Leu-Ala-Ala-Asp-Thr-Pro-Thr-Ala-(OH)NH₂  (SEQ ID NO:729)
```

Preferred embodiments of linear MIP-1α analogs of the present invention corresponding to a portion of the internal region of MIP-1α having the following sequences:

```
[A¹¹]-MIP-1α-(11-31) acid or amide
c2)  RNH-Ala-Phe-Ser-Tyr-Thr-Ser-Arg-Gln-Ile-Pro-Gln-Asn-Ala-Asp-Tyr-Phe-Glu-Thr-   (SEQ ID NO:730)
     Ser-Ser-Gln-(OH)NH₂

MIP-1α-(33-47) acid or amide
c3)  RNH-Ser-Lys-Pro-Gly-Val-Ile-Phe-Leu-Thr-Tyr-Arg-Ser-Arg-Gln-Val-(OH)NH₂       (SEQ ID NO:731)
```

Preferred embodiments of linear MIP-1α analogs of the present invention corresponding to a portion of the N-terminal and the internal region of MIP-1α having the following structures:

MIP-1α-(1–31) acid or amide c4) RNH-Ser-Leu-Ala-Ala-Asp-Thr-Pro-Thr-Cys-Cys-Phe-Ser-Tyr-Thr-Ser-Arg-Gln-Ile- (SEQ ID NO:732)
Pro-Gln-Asn-Ala-Asp-Tyr-Phe-Glu-Thr-Ser-Ser-Gln-(OH)NH$_2$ c5) RNH-Xaa$_3$-Leu-Ala-Ala-Asp-Thr-Pro-Thr-Xaa$_1$-Xaa$_2$-Phe-Ser-Tyr-Thr-Ser-Arg-Gln- (SEQ ID NO:733)
Ile-Pro-Gln-Asn-Ala-Asp-Tyr-Phe-Glu-Thr-Ser-Ser-Gln-(OH)NH$_2$ c6) RNH-Ser-Xaa$_3$-Ala-Ala-Asp-Thr-Pro-Thr-Xaa$_1$-Xaa$_2$-Phe-Ser-Tyr-Thr-Ser-Arg-Gln- (SEQ ID NO:734)
Ile-Pro-Gln-Asn-Ala-Asp-Tyr-Phe-Glu-Thr-Ser-Ser-Gln-(OH)NH$_2$ c7) RNH-Ser-Leu-Xaa$_3$-Ala-Asp-Thr-Pro-Thr-Xaa$_1$-Xaa2-Phe-Ser-Tyr-Thr-Ser-Arg-Gln- (SEQ ID NO:735)
Ile-Pro-Gln-Asn-Ala-Asp-Tyr-Phe-Glu-Thr-Ser-Ser-Gln-(OH)NH$_2$ c8) RNH-Ser-Leu-Ala-Xaa$_3$-Asp-Thr-Pro-Thr-Xaa$_1$-Xaa$_2$-Phe-Ser-Tyr-Thr-Ser-Arg-Gln- (SEQ ID NO:736)
Ile-Pro-Gln-Asn-Ala-Asp-Tyr-Phe-Glu-Thr-Ser-Ser-Gln-(OH)NH$_2$ c9) RNH-Ser-Leu-Ala-Ala-Xaa$_3$-Thr-Pro-Thr-Xaa$_1$-Xaa$_2$-Phe-Ser-Tyr-Thr-Ser-Arg-Gln- (SEQ ID NO:737)
Ile-Pro-Gln-Asn-Ala-Asp-Tyr-Phe-Glu-Thr-Ser-Ser-Gln-(OH)NH$_2$ c10) RNH-Ser-Leu-Ala-Ala-Asp-Xaa$_3$-Pro-Thr-Xaa$_1$-Xaa$_2$-Phe-Ser-Tyr-Thr-Ser-Arg-Gln- (SEQ ID NO:738)
Ile-Pro-Gln-Asn-Ala-Asp-Tyr-Phe-Glu-Thr-Ser-Ser-Gln-(OH)NH$_2$ c11) RNH-Ser-Leu-Ala-Ala-Asp-Thr-Xaa$_3$-Thr-Xaa$_1$-Xaa$_2$-Phe-Ser-Tyr-Thr-Ser-Arg-Gln- (SEQ ID NO:739)
Ile-Pro-Gln-Asn-Ala-Asp-Tyr-Phe-Glu-Thr-Ser-Ser-Gln-(OH)NH$_2$ c12) RNH-Ser-Leu-Ala-Ala-Asp-Thr-Pro-Xaa$_3$-Xaa$_1$-Xaa$_2$-Phe-Ser-Tyr-Thr-Ser-Arg-Gln- (SEQ ID NO:740)
Ile-Pro-Gln-Asn-Ala-Asp-Tyr-Phe-Glu-Thr-Ser-Ser-Gln-(OH)NH$_2$ Preferred embodiments of linear MIP-1α analogs of the present invention corresponding to a portion of the C-terminal region of MIP-1α having the following structures:

MIP-1α-(49–66) acid or amide c13) RNH-Ala-Asp-Pro-Ser-Glu-Glu-Trp-Val-Gln-Tyr-Val-Asp-Asp-Leu-Glu-Leu-Ser-Ala- (SEQ ID NO:741)
(OH)NH$_2$ Preferred embodiments of linear MIP-1α analogs of the present invention corresponding to a portion the N-terminal region joined with a linker to the C-terminal region of MIP-1α having the following structures:

MIP-1α-(1–14)-[linker]-MIP-1α-(53–66) acid or amide c14) RNH-Ser-Leu-Ala-Ala-Asp-Thr-Pro-Thr-Cys-Cys-Phe-Ser-Tyr-Thr-[linker]-Glu-Glu- (SEQ ID NO:742)
Trp-Val-Gln-Tyr-Val-Asp-Asp-Leu-Glu-Leu-Ser-Ala-(OH)NH$_2$ c15) RNH-Ser-Leu-Ala-Ala-Asp-Thr-Pro-Thr-Xaa$_1$-Xaa$_2$-Phe-Ser-Tyr-Thr-[linker]-Glu- (SEQ ID NO:743)
Glu-Trp-Val-Gln-Tyr-Val-Asp-Asp-Leu-Glu-Leu-Ser-Ala-(OH)NH$_2$ c16) RNH-Xaa$_3$-Leu-Ala-Ala-Asp-Thr-Pro-Thr-Xaa$_1$-Xaa$_2$-Phe-Ser-Tyr-Thr-[linker]-Glu- (SEQ ID NO:744)
Glu-Trp-Val-Gln-Tyr-Val-Asp-Asp-Leu-Glu-Leu-Ser-Ala-(OH)NH$_2$ c17) RNH-Ser-Xaa$_3$-Ala-Ala-Asp-Thr-Pro-Thr-Xaa$_1$-Xaa$_2$-Phe-Ser-Tyr-Thr-[linker]-Glu- (SEQ ID NO:745)
Glu-Trp-Val-Gln-Tyr-Val-Asp-Asp-Leu-Glu-Leu-Ser-Ala-(OH)NH$_2$ c18) RNH-Ser-Leu-Xaa$_3$-Ala-Asp-Thr-Pro-Thr-Xaa$_1$-Xaa$_2$-Phe-Ser-Tyr-Thr-[linker]-Glu- (SEQ ID NO:746)
Glu-Trp-Val-Gln-Tyr-Val-Asp-Asp-Leu-Glu-Leu-Ser-Ala-(OH)NH$_2$ c19) RNH-Ser-Leu-Ala-Xaa$_3$-Asp-Thr-Pro-Thr-Xaa$_1$-Xaa$_2$-Phe-Ser-Tyr-Thr-[linker]-Glu- (SEQ ID NO:747)
Glu-Trp-Val-Gln-Tyr-Val-Asp-Asp-Leu-Glu-Leu-Ser-Ala-(OH)NH$_2$ c20) RNH-Ser-Leu-Ala-Ala-Xaa$_3$-Thr-Pro-Thr-Xaa$_1$-Xaa$_2$-Phe-Ser-Tyr-Thr-[linker]-Glu- (SEQ ID NO:748)
Glu-Trp-Val-Gln-Tyr-Val-Asp-Asp-Leu-Glu-Leu-Ser-Ala(OH)NH$_2$ c21) RNH-Ser-Leu-Ala-Ala-Asp-Xaa$_3$-Pro-Thr-Xaa$_1$-Xaa$_2$-Phe-Ser-Tyr-Thr-[linker]-Glu- (SEQ ID NO:749)
Glu-Trp-Val-Gln-Tyr-Val-Asp-Asp-Leu-Glu-Leu-Ser-Ala-(OH)NH$_2$ c22) RNH-Ser-Leu-Ala-Ala-Asp-Thr-Xaa$_3$-Thr-Xaa$_1$-Xaa$_2$-Phe-Ser-Tyr-Thr-[linker]-Glu- (SEQ ID NO:750)
Glu-Trp-Val-Gln-Tyr-Val-Asp-Asp-Leu-Glu-Leu-Ser-Ala-(OH)NH$_2$ c23) RNH-Ser-Leu-Ala-Ala-Asp-Thr-Pro-Xaa$_3$-Xaa$_1$-Xaa$_2$-Phe-Ser-Tyr-Thr-[linker]-Glu- (SEQ ID NO:751)
Glu-Trp-Val-Gln-Tyr-Val-Asp-Asp-Leu-Glu-Leu-Ser-Ala-(OH)NH$_2$

| | | |
|---|---|---|
| c24) | RNH-Ser-Leu-Ala-Ala-Asp-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:752) |
| c25) | RNH-Xaa$_3$-Leu-Ala-Ala-Asp-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:753) |
| c26) | RNH-Ser-Xaa$_3$-Ala-Ala-Asp-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:754) |
| c27) | RNH-Ser-Leu-Xaa$_3$-Ala-Asp-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:755) |
| c28) | RNH-Ser-Leu-Ala-Xaa$_3$-Asp-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:756) |
| c29) | RNH-Ser-Leu-Ala-Ala-Xaa$_3$-Thr-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:757) |
| c30) | RNH-Ser-Leu-Ala-Ala-Asp-Xaa$_3$-Pro-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:758) |
| c31) | RNH-Ser-Leu-Ala-Ala-Asp-Thr-Xaa$_3$-Thr-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:759) |
| c32) | RNH-Ser-Leu-Ala-Ala-Asp-Thr-Pro-Xaa$_3$-Xaa$_1$-Xaa$_2$-Xaa$_4$-Ser-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:760) |
| c33) | RNH-Ser-Leu-Ala-Ala-Asp-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:761) |
| c34) | RNH-Xaa$_3$-Leu-Ala-Ala-Asp-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:762) |
| c35) | RNH-Ser-Xaa$_3$-Ala-Ala-Asp-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:763) |
| c36) | RNH-Ser-Leu-Xaa$_3$-Ala-Asp-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:764) |
| c37) | RNH-Ser-Leu-Ala-Xaa$_3$-Asp-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:765) |
| c38) | RNH-Ser-Leu-Ala-Ala-Xaa$_3$-Thr-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:766) |
| c39) | RNH-Ser-Leu-Ala-Ala-Asp-Xaa$_3$-Pro-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:767) |
| c40) | RNH-Ser-Leu-Ala-Ala-Asp-Thr-Xaa$_3$-Thr-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:768) |
| c41) | RNH-Ser-Leu-Ala-Ala-Asp-Thr-Pro-Xaa$_3$-Xaa$_1$-Xaa$_2$-Phe-Xaa$_4$-Tyr-Thr-[linker]-Glu-Glu-Trp-Val-Gln-Tyr-Val-Asp-Asp-Leu-Glu-Leu-Ser-Ala-(OH)NH$_2$ | (SEQ ID NO:769) |
| c42) | RNH-Ser-Leu-Ala-Ala-Asp-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:770) |
| c43) | RNH-Xaa$_3$-Leu-Ala-Ala-Asp-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:771) |
| c44) | RNH-Ser-Xaa$_3$-Ala-Ala-Asp-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:772) |
| c45) | RNH-Ser-Leu-Xaa$_3$-Ala-Asp-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:773) |
| c46) | RNH-Ser-Leu-Ala-Xaa$_3$-Asp-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:774) |
| c47) | RNH-Ser-Leu-Ala-Ala-Xaa$_3$-Thr-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:775) |
| c48) | RNH-Ser-Leu-Ala-Ala-Asp-Xaa$_3$-Pro-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:776) |
| c49) | RNH-Ser-Leu-Ala-Ala-Asp-Thr-Xaa$_3$-Thr-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:777) |
| c50) | RNH-Ser-Leu-Ala-Ala-Asp-Thr-Pro-Xaa$_3$-Xaa$_1$-Xaa$_2$-Phe-Ser-Xaa$_4$-Thr-[linker]-Glu-Glu-Trp-Val-Gln-Tyr-Val-Asp-Asp-Leu-Glu-Leu-Ser-Ala-(OH)NH$_2$ | (SEQ ID NO:778) |

```
c51)  RNH-Ser-Leu-Ala-Ala-Asp-Thr-Pro-Thr-Xaa₁-Xaa₂-Phe-Ser-Tyr-Xaa₄-[linker]-Glu-      (SEQ ID NO:779)
      Glu-Trp-Val-Gln-Tyr-Val-Asp-Asp-Leu-Glu-Leu-Ser-Ala-(OH)NH₂ c52)  RNH-Xaa₃-Leu-Ala-Ala-Asp-Thr-Pro-Thr-Xaa₁-Xaa₂-Phe-Ser-Tyr-Xaa₄-[linker]-Glu-     (SEQ ID NO:780)
      Glu-Trp-Val-Gln-Tyr-Val-Asp-Asp-Leu-Glu-Leu-Ser-Ala-(OH)NH₂ c53)  RNH-Ser-Xaa₃-Ala-Ala-Asp-Thr-Pro-Thr-Xaa₁-Xaa₂-Phe-Ser-Tyr-Xaa₄-[linker]-Glu-     (SEQ ID NO:781)
      Glu-Trp-Val-Gln-Tyr-Val-Asp-Asp-Leu-Glu-Leu-Ser-Ala-(OH)NH₂ c54)  RNH-Ser-Leu-Xaa₃-Ala-Asp-Thr-Pro-Thr-Xaa₁-Xaa₂-Phe-Ser-Tyr-Xaa₄-[linker]-Glu-     (SEQ ID NO:782)
      Glu-Trp-Val-Gln-Tyr-Val-Asp-Asp-Leu-Glu-Leu-Ser-Ala-(OH)NH₂ c55)  RNH-Ser-Leu-Ala-Xaa₃-Asp-Thr-Pro-Thr-Xaa₁-Xaa₂-Phe-Ser-Tyr-Xaa₄-[linker]-Glu-     (SEQ ID NO:783)
      Glu-Trp-Val-Gln-Tyr-Val-Asp-Asp-Leu-Glu-Leu-Ser-Ala-(OH)NH₂ c56)  RNH-Ser-Leu-Ala-Ala-Xaa₃-Thr-Pro-Thr-Xaa₁-Xaa₂-Phe-Ser-Tyr-Xaa₄-[linker]-Glu-     (SEQ ID NO:784)
      Glu-Trp-Val-Gln-Tyr-Val-Asp-Asp-Leu-Glu-Leu-Ser-Ala-(OH)NH₂ c57)  RNH-Ser-Leu-Ala-Ala-Asp-Xaa₃-Pro-Thr-Xaa₁-Xaa₂-Phe-Ser-Tyr-Xaa₄-[linker]-Glu-     (SEQ ID NO:785)
      Glu-Trp-Val-Gln-Tyr-Val-Asp-Asp-Leu-Glu-Leu-Ser-Ala-(OH)NH₂ c58)  RNH-Ser-Leu-Ala-Ala-Asp-Thr-Xaa₃-Thr-Xaa₁-Xaa₂-Phe-Ser-Tyr-Xaa₄-[linker]-Glu-     (SEQ ID NO:786)
      Glu-Trp-Val-Gln-Tyr-Val-Asp-Asp-Leu-Glu-Leu-Ser-Ala-(OH)NH₂ c59)  RNH-Ser-Leu-Ala-Ala-Asp-Thr-Pro-Xaa₃-Xaa₁-Xaa₂-Phe-Ser-Tyr-Xaa₄-[linker]-Glu-     (SEQ ID NO:787)
      Glu-Trp-Val-Gln-Tyr-Val-Asp-Asp-Leu-Glu-Leu-Ser-Ala-(OH)NH₂
```

In some preferred embodiments, glutamine (Gln57) of MIP-1α analogs was replaced by lysine (Lys).

```
MIP-1α-(1–14)-[linker]-[K⁵⁷]-MIP-1α-(53–66) acid or amide
c60)  RNH-Ser-Leu-Ala-Ala-Asp-Thr-Pro-Thr-Cys-Cys-Phe-Ser-Tyr-Thr-[linker]-Glu-Glu-    (SEQ ID NO:788)
      Trp-Val-Lys-Tyr-Val-Asp-Asp-Leu-Glu-Leu-Ser-Ala-(OH)NH₂ c61)  RNH-Ser-Leu-Ala-Ala-Asp-Thr-Pro-Thr-Xaa₁-Xaa₂-Phe-Ser-Tyr-Thr-[linker]-Glu-      (SEQ ID NO:789)
      Glu-Trp-Val-Lys-Tyr-Val-Asp-Asp-Leu-Glu-Leu-Ser-Ala-(OH)NH₂ c62)  RNH-Xaa₃-Leu-Ala-Ala-Asp-Thr-Pro-Thr-Xaa₁-Xaa₂-Phe-Ser-Tyr-Thr-[linker]-Glu-     (SEQ ID NO:790)
      Glu-Trp-Val-Lys-Tyr-Val-Asp-Asp-Leu-Glu-Leu-Ser-Ala-(OH)NH₂ c63)  RNH-Ser-Xaa₃-Ala-Ala-Asp-Thr-Pro-Thr-Xaa₁-Xaa₂-Phe-Ser-Tyr-Thr-[linker]-Glu-     (SEQ ID NO:791)
      Glu-Trp-Val-Lys-Tyr-Val-Asp-Asp-Leu-Glu-Leu-Ser-Ala-(OH)NH₂ c64)  RNH-Ser-Leu-Xaa₃-Ala-Asp-Thr-Pro-Thr-Xaa₁-Xaa₂-Phe-Ser-Tyr-Thr-[linker]-Glu-     (SEQ ID NO:792)
      Glu-Trp-Val-Lys-Tyr-Val-Asp-Asp-Leu-Glu-Leu-Ser-Ala-(OH)NH₂ c65)  RNH-Ser-Leu-Ala-Xaa₃-Asp-Thr-Pro-Thr-Xaa₁-Xaa₂-Phe-Ser-Tyr-Thr-[linker]-Glu-     (SEQ ID NO:793)
      Glu-Trp-Val-Lys-Tyr-Val-Asp-Asp-Leu-Glu-Leu-Ser-Ala-(OH)NH₂ c66)  RNH-Ser-Leu-Ala-Ala-Xaa₃-Thr-Pro-Thr-Xaa₁-Xaa₂-Phe-Ser-Tyr-Thr-[linker]-Glu-     (SEQ ID NO:794)
      Glu-Trp-Val-Lys-Tyr-Val-Asp-Asp-Leu-Glu-Leu-Ser-Ala-(OH)NH₂ c67)  RNH-Ser-Leu-Ala-Ala-Asp-Xaa₃-Pro-Thr-Xaa₁-Xaa₂-Phe-Ser-Tyr-Thr-[linker]-Glu-     (SEQ ID NO:795)
      Glu-Trp-Val-Lys-Tyr-Val-Asp-Asp-Leu-Glu-Leu-Ser-Ala-(OH)NH₂ c68)  RNH-Ser-Leu-Ala-Ala-Asp-Thr-Xaa₃-Thr-Xaa₁-Xaa₂-Phe-Ser-Tyr-Thr-[linker]-Glu-     (SEQ ID NO:796)
      Glu-Trp-Val-Lys-Tyr-Val-Asp-Asp-Leu-Glu-Leu-Ser-Ala-(OH)NH₂ c69)  RNH-Ser-Leu-Ala-Ala-Asp-Thr-Pro-Xaa₃-Xaa₁-Xaa₂-Phe-Ser-Tyr-Thr-[linker]-Glu-     (SEQ ID NO:797)
      Glu-Trp-Val-Lys-Tyr-Val-Asp-Asp-Leu-Glu-Leu-Ser-Ala-(OH)NH₂ c70)  RNH-Ser-Leu-Ala-Ala-Asp-Thr-Pro-Thr-Xaa₁-Xaa₂-Xaa₄-Ser-Tyr-Thr-[linker]-Glu-     (SEQ ID NO:798)
      Glu-Trp-Val-Lys-Tyr-Val-Asp-Asp-Leu-Glu-Leu-Ser-Ala-(OH)NH₂ c71)  RNH-Xaa₃-Leu-Ala-Ala-Asp-Thr-Pro-Thr-Xaa₁-Xaa₂-Xaa₄-Ser-Tyr-Thr-[linker]-Glu-    (SEQ ID NO:799)
      Glu-Trp-Val-Lys-Tyr-Val-Asp-Asp-Leu-Glu-Leu-Ser-Ala-(OH)NH₂ c72)  RNH-Ser-Xaa₃-Ala-Ala-Asp-Thr-Pro-Thr-Xaa₁-Xaa₂-Xaa₄-Ser-Tyr-Thr-[linker]-Glu-    (SEQ ID NO:800)
      Glu-Trp-Val-Lys-Tyr-Val-Asp-Asp-Leu-Glu-Leu-Ser-Ala-(OH)NH₂ c73)  RNH-Ser-Leu-Xaa₃-Ala-Asp-Thr-Pro-Thr-Xaa₁-Xaa₂-Xaa₄-Ser-Tyr-Thr-[linker]-Glu-    (SEQ ID NO:801)
      Glu-Trp-Val-Lys-Tyr-Val-Asp-Asp-Leu-Glu-Leu-Ser-Ala-(OH)NH₂ c74)  RNH-Ser-Leu-Ala-Xaa₃-Asp-Thr-Pro-Thr-Xaa₁-Xaa₂-Xaa₄-Ser-Tyr-Thr-[linker]-Glu-    (SEQ ID NO:802)
      Glu-Trp-Val-Lys-Tyr-Val-Asp-Asp-Leu-Glu-Leu-Ser-Ala-(OH)NH₂
``` c75) RNH-Ser-Leu-Ala-Ala-Xaa$_3$-Thr-Pro-Thr-Xaa$_1$-Xaa$_2$-Xaa$_4$-Ser-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:803)

c76) RNH-Ser-Leu-Ala-Ala-Asp-Xaa$_3$-Pro-Thr-Xaa$_1$-Xaa$_2$-Xaa$_4$-Ser-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:804)

c77) RNH-Ser-Leu-Ala-Ala-Asp-Thr-Xaa$_3$-Thr-Xaa$_1$-Xaa$_2$-Xaa$_4$-Ser-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:805)

c78) RNH-Ser-Leu-Ala-Ala-Asp-Thr-Pro-Xaa$_3$-Xaa$_1$-Xaa$_2$-Xaa$_4$-Ser-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:806)

c79) RNH-Ser-Leu-Ala-Ala-Asp-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:807)

c80) RNH-Xaa$_3$-Leu-Ala-Ala-Asp-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:808)

c81) RNH-Ser-Xaa$_3$-Ala-Ala-Asp-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:809)

c82) RNH-Ser-Leu-Xaa$_3$-Ala-Asp-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:810)

c83) RNH-Ser-Leu-Ala-Xaa$_3$-Asp-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:811)

c84) RNH-Ser-Leu-Ala-Ala-Xaa$_3$-Thr-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:812)

c85) RNH-Ser-Leu-Ala-Ala-Asp-Xaa$_3$-Pro-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:813)

c86) RNH-Ser-Leu-Ala-Ala-Asp-Thr-Xaa$_3$-Thr-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:814)

c87) RNH-Ser-Leu-Ala-Ala-Asp-Thr-Pro-Xaa$_3$-Xaa$_1$-Xaa$_2$-Phe-Xaa$_4$-Tyr-Thr-[linker]-Glu-Glu-Trp-Val-Lys-Tyr-Val-Asp-Asp-Leu-Glu-Leu-Ser-Ala-(OH)NH$_2$ (SEQ ID NO:815)

c88) RNH-Ser-Leu-Ala-Ala-Asp-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:816)

c89) RNH-Xaa$_3$-Leu-Ala-Ala-Asp-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:817)

c90) RNH-Ser-Xaa$_3$-Ala-Ala-Asp-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:818)

c91) RNH-Ser-Leu-Xaa$_3$-Ala-Asp-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:819)

c92) RNH-Ser-Leu-Ala-Xaa$_3$-Asp-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:820)

c93) RNH-Ser-Leu-Ala-Ala-Xaa$_3$-Thr-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:821)

c94) RNH-Ser-Leu-Ala-Ala-Asp-Xaa$_3$-Pro-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:822)

c95) RNH-Ser-Leu-Ala-Ala-Asp-Thr-Xaa$_3$-Thr-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:823)

c96) RNH-Ser-Leu-Ala-Ala-Asp-Thr-Pro-Xaa$_3$-Xaa$_1$-Xaa$_2$-Phe-Ser-Xaa$_4$-Thr-[linker]-Glu-Glu-Trp-Val-Lys-Tyr-Val-Asp-Asp-Leu-Glu-Leu-Ser-Ala-(OH)NH$_2$ (SEQ ID NO:824)

c97) RNH-Ser-Leu-Ala-Ala-Asp-Thr-Pro-Thr-Xaa$_1$-Xaa$_2$-Phe-Ser-Tyr-Xaa$_4$-[linker]-Glu-Glu-Trp-Val-Lys-Tyr-Val-Asp-Asp-Leu-Glu-Leu-Ser-Ala-(OH)NH$_2$ (SEQ ID NO:825)

c98) RNH-Xaa$_3$-Leu-Ala-Ala-Asp-Thr-Pro-Thr-Xaa$_1$-Xaa$_2$-Phe-Ser-Tyr-Xaa$_4$-[linker]-Glu-Glu-Trp-Val-Lys-Tyr-Val-Asp-Asp-Leu-Glu-Leu-Ser-Ala-(OH)NH$_2$ (SEQ ID NO:826)

c99) RHN-Ser-Xaa$_3$-Ala-Ala-Asp-Thr-Pro-Thr-Xaa$_1$-Xaa$_2$-Phe-Ser-Tyr-Xaa$_4$-[linker]-Glu-Glu-Trp-Val-Lys-Tyr-Val-Asp-Asp-Leu-Glu-Leu-Ser-Ala-(OH)NH$_2$ (SEQ ID NO:827)

c100) RNH-Ser-Leu-Xaa$_3$-Ala-Asp-Thr-Pro-Thr-Xaa$_1$-Xaa$_2$-Phe-Ser-Tyr-Xaa$_4$-[linker]-Glu-Glu-Trp-Val-Lys-Tyr-Val-Asp-Asp-Leu-Glu-Leu-Ser-Ala-(OH)NH$_2$ (SEQ ID NO:828)

-continued c101) RNH-Ser-Leu-Ala-Xaa$_3$-Asp-Thr-Pro-Thr-Xaa$_1$-Xaa$_2$-Phe-Ser-Tyr-Xaa$_4$-[linker]-Glu-  (SEQ ID NO:829)
Glu-Trp-Val-Lys-Tyr-Val-Asp-Asp-Leu-Glu-Leu-Ser-Ala-(OH)NH$_2$ c102) RNH-Ser-Leu-Ala-Ala-Xaa$_3$-Thr-Pro-Thr-Xaa$_1$-Xaa$_2$-Phe-Ser-Tyr-Xaa$_4$-[linker]-Glu-  (SEQ ID NO:830)
Glu-Trp-Val-Lys-Tyr-Val-Asp-Asp-Leu-Glu-Leu-Ser-Ala-(OH)NH$_2$ c103) RNH-Ser-Leu-Ala-Ala-Asp-Xaa$_3$-Pro-Thr-Xaa$_1$-Xaa$_2$-Phe-Ser-Tyr-Xaa$_4$-[linker]-Glu-  (SEQ ID NO:831)
Glu-Trp-Val-Lys-Tyr-Val-Asp-Asp-Leu-Glu-Leu-Ser-Ala-(OH)NH$_2$ c104) RNH-Ser-Leu-Ala-Ala-Asp-Thr-Xaa$_3$-Thr-Xaa$_1$-Xaa$_2$-Phe-Ser-Tyr-Xaa$_4$-[linker]-Glu-  (SEQ ID NO:832)
Glu-Trp-Val-Lys-Tyr-Val-Asp-Asp-Leu-Glu-Leu-Ser-Ala-(OH)NH$_2$ c105) RNH-Ser-Leu-Ala-Ala-Asp-Thr-Pro-Xaa$_3$-Xaa$_1$-Xaa$_2$-Phe-Ser-Tyr-Xaa$_4$-[linker]-Glu-  (SEQ ID NO:833)
Glu-Trp-Val-Lys-Tyr-Val-Asp-Asp-Leu-Glu-Leu-Ser-Ala-(OH)NH$_2$ Preferred embodiments of cyclic MIP-1α analogs of the present invention corresponding to a cyclic portion of the internal region of MIP-1α having the following structures:

[A$^{10}$]-MIP-1α-(10–32) cyclic(Cys11-Cys32) acid or amide
c106) RNH-Ala-Cys-Phe-Ser-Tyr-Thr-Ser-Arg-Gln-Ile-Pro-Gln-Asn-Ala-Asp-Tyr-Phe-Glu-  (SEQ ID NO:834)
Thr-Ser-Ser-Gln-Cys-(OH)NH$_2$

[A$^{10}$, K$^{11}$, E$^{32}$]-MIP-1α-(10–32) cyclic(Lys11-Glu32) acid or amide
c107) RNH-Ala-Lys-Phe-Ser-Tyr-Thr-Ser-Arg-Gln-Ile-Pro-Gln-Asn-Ala-Asp-Tyr-Phe-Glu-  (SEQ ID NO:835)
Thr-Ser-Ser-Gln-Glu-(OH)NH$_2$ Preferred embodiments of cyclic MIP-1α analogs of the present invention corresponding to a portion of the N-terminal region joined with a linker to a cyclic the C-terminal region of MIP-1α having the following structures:

MIP-1α-(1–14)-[linker]-[K$^{57}$]-MIP-1α-(53–66) cyclic(Lys57-Asp61) acid or amide
c108) RNH-Ser-Leu-Ala-Ala-Asp-Thr-Pro-Thr-Cys-Cys-Phe-Ser-Tyr-Thr-[linker]-Glu-Glu-  (SEQ ID NO:836)
Trp-Val-Lys-Tyr-Val-Asp-Asp-Leu-Glu-Leu-Ser-Ala-(OH)NH$_2$ c109) RNH-Ser-Leu-Ala-Ala-Asp-Thr-Pro-Thr-Xaa$_1$-Xaa$_2$-Phe-Ser-Tyr-Thr-[linker]-Glu-  (SEQ ID NO:837)
Glu-Trp-Val-Lys-Tyr-Val-Asp-Asp-Leu-Glu-Leu-Ser-Ala-(OH)NH$_2$ c110) RNH-Xaa$_3$-Leu-Ala-Ala-Asp-Thr-Pro-Thr-Xaa$_1$-Xaa$_2$-Phe-Ser-Tyr-Thr-[linker]-Glu-  (SEQ ID NO:838)
Glu-Trp-Val-Lys-Tyr-Val-Asp-Asp-Leu-Glu-Leu-Ser-Ala-(OH)NH$_2$ c111) RNH-Ser-Xaa$_3$-Ala-Ala-Asp-Thr-Pro-Thr-Xaa$_1$-Xaa$_2$-Phe-Ser-Tyr-Thr-[linker]-Glu-  (SEQ ID NO:839)
Glu-Trp-Val-Lys-Tyr-Val-Asp-Asp-Leu-Glu-Leu-Ser-Ala-(OH)NH$_2$ c112) RNH-Ser-Leu-Xaa$_3$-Ala-Asp-Thr-Pro-Thr-Xaa$_1$-Xaa$_2$-Phe-Ser-Tyr-Thr-[linker]-Glu-  (SEQ ID NO:840)
Glu-Trp-Val-Lys-Tyr-Val-Asp-Asp-Leu-Glu-Leu-Ser-Ala-(OH)NH$_2$ c120) RNH-Ser-Leu-Ala-Xaa$_3$-Asp-Thr-Pro-Thr-Xaa$_1$-Xaa$_2$-Phe-Ser-Tyr-Thr-[linker]-Glu-  (SEQ ID NO:841)
Glu-Trp-Val-Lys-Tyr-Val-Asp-Asp-Leu-Glu-Leu-Ser-Ala-(OH)NH$_2$ c121) RNH-Ser-Leu-Ala-Ala-Xaa$_3$-Thr-Pro-Thr-Xaa$_1$-Xaa$_2$-Phe-Ser-Tyr-Thr-[linker]-Glu-  (SEQ ID NO:842)
Glu-Trp-Val-Lys-Tyr-Val-Asp-Asp-Leu-Glu-Leu-Ser-Ala-(OH)NH$_2$ c122) RNH-Ser-Leu-Ala-Ala-Asp-Xaa$_3$-Pro-Thr-Xaa$_1$-Xaa$_2$-Phe-Ser-Tyr-Thr-[linker]-Glu-  (SEQ ID NO:843)
Glu-Trp-Val-Lys-Tyr-Val-Asp-Asp-Leu-Glu-Leu-Ser-Ala-(OH)NH$_2$ c123) RNH-Ser-Leu-Ala-Ala-Asp-Thr-Xaa$_3$-Thr-Xaa$_1$-Xaa$_2$-Phe-Ser-Tyr-Thr-[linker]-Glu-  (SEQ ID NO:844)
Glu-Trp-Val-Lys-Tyr-Val-Asp-Asp-Leu-Glu-Leu-Ser-Ala-(OH)NH$_2$ c124) RNH-Ser-Leu-Ala-Ala-Asp-Thr-Pro-Xaa$_3$-Xaa$_1$-Xaa$_2$-Phe-Ser-Tyr-Thr-[linker]-Glu-  (SEQ ID NO:845)
Glu-Trp-Val-Lys-Tyr-Val-Asp-Asp-Leu-Glu-Leu-Ser-Ala-(OH)NH$_2$ c125) RNH-Ser-Leu-Ala-Ala-Asp-Thr-Pro-Thr-Xaa$_1$-Xaa$_2$-Xaa$_4$-Ser-Tyr-Thr-[linker]-Glu-  (SEQ ID NO:846)
Glu-Trp-Val-Lys-Tyr-Val-Asp-Asp-Leu-Glu-Leu-Ser-Ala-(OH)NH$_2$ c126) RNH-Xaa$_3$-Leu-Ala-Ala-Asp-Thr-Pro-Thr-Xaa$_1$-Xaa$_2$-Xaa$_4$-Ser-Tyr-Thr-[linker]-Glu-  (SEQ ID NO:847)
Glu-Trp-Val-Lys-Tyr-Val-Asp-Asp-Leu-Glu-Leu-Ser-Ala-(OH)NH$_2$ c127) RNH-Ser-Xaa$_3$-Ala-Ala-Asp-Thr-Pro-Thr-Xaa$_1$-Xaa$_2$-Xaa$_4$-Ser-Tyr-Thr-[linker]-Glu-  (SEQ ID NO:848)
Glu-Trp-Val-Lys-Tyr-Val-Asp-Asp-Leu-Glu-Leu-Ser-Ala-(OH)NH$_2$ -continued c128) RNH-Ser-Leu-Xaa$_3$-Ala-Asp-Thr-Pro-Thr-Xaa$_1$-Xaa$_2$-Xaa$_4$-Ser-Tyr-Thr-[linker]-Glu-  (SEQ ID NO:849)
Glu-Trp-Val-<u>Lys</u>-Tyr-Val-Asp-<u>Asp</u>-Leu-Glu-Leu-Ser-Ala-(OH)NH$_2$ c129) RNH-Ser-Leu-Ala-Xaa$_3$-Asp-Thr-Pro-Thr-Xaa$_1$-Xaa$_2$-Xaa$_4$-Ser-Tyr-Thr-[linker]-Glu-  (SEQ ID NO:850)
Glu-Trp-Val-<u>Lys</u>-Tyr-Val-Asp-<u>Asp</u>-Leu-Glu-Leu-Ser-Ala-(OH)NH$_2$ c130) RNH-Ser-Leu-Ala-Ala-Xaa$_3$-Thr-Pro-Thr-Xaa$_1$-Xaa$_2$-Xaa$_4$-Ser-Tyr-Thr-[linker]-Glu-  (SEQ ID NO:851)
Glu-Trp-Val-<u>Lys</u>-Tyr-Val-Asp-<u>Asp</u>-Leu-Glu-Leu-Ser-Ala-(OH)NH$_2$ c131) RNH-Ser-Leu-Ala-Ala-Asp-Xaa$_3$-Pro-Thr-Xaa$_1$-Xaa$_2$-Xaa$_4$-Ser-Tyr-Thr-[linker]-Glu-  (SEQ ID NO:852)
Glu-Trp-Val-<u>Lys</u>-Tyr-Val-Asp-<u>Asp</u>-Leu-Glu-Leu-Ser-Ala-(OH)NH$_2$ c132) RNH-Ser-Leu-Ala-Ala-Asp-Thr-Xaa$_3$-Thr-Xaa$_1$-Xaa$_2$-Xaa$_4$-Ser-Tyr-Thr-[linker]-Glu-  (SEQ ID NO:853)
Glu-Trp-Val-<u>Lys</u>-Tyr-Val-Asp-<u>Asp</u>-Leu-Glu-Leu-Ser-Ala-(OH)NH$_2$ c133) RNH-Ser-Leu-Ala-Ala-Asp-Thr-Pro-Xaa$_3$-Xaa$_1$-Xaa$_2$-Xaa$_4$-Ser-Tyr-Thr-[linker]-Glu-  (SEQ ID NO:854)
Glu-Trp-Val-<u>Lys</u>-Tyr-Val-Asp-<u>Asp</u>-Leu-Glu-Leu-Ser-Ala-(OH)NH$_2$ c134) RNH-Ser-Leu-Ala-Ala-Asp-Thr-Pro-Thr-Xaa$_1$-Xaa$_2$-Phe-Xaa$_4$-Tyr-Thr-[linker]-Glu-  (SEQ ID NO:855)
Glu-Trp-Val-<u>Lys</u>-Tyr-Val-Asp-<u>Asp</u>-Leu-Glu-Leu-Ser-Ala-(OH)NH$_2$ c135) RNH-Xaa$_3$-Leu-Ala-Ala-Asp-Thr-Pro-Thr-Xaa$_1$-Xaa$_2$-Phe-Xaa$_4$-Tyr-Thr-[linker]-Glu-  (SEQ ID NO:856)
Glu-Trp-Val-<u>Lys</u>-Tyr-Val-Asp-<u>Asp</u>-Leu-Glu-Leu-Ser-Ala-(OH)NH$_2$ c136) RNH-Ser-Xaa$_3$-Ala-Ala-Asp-Thr-Pro-Thr-Xaa$_1$-Xaa$_2$-Phe-Xaa$_4$-Tyr-Thr-[linker]-Glu-  (SEQ ID NO:857)
Glu-Trp-Val-<u>Lys</u>-Tyr-Val-Asp-<u>Asp</u>-Leu-Glu-Leu-Ser-Ala-(OH)NH$_2$ c137) RNH-Ser-Leu-Xaa$_3$-Ala-Asp-Thr-Pro-Thr-Xaa$_1$-Xaa$_2$-Phe-Xaa$_4$-Tyr-Thr-[linker]-Glu-  (SEQ ID NO:858)
Glu-Trp-Val-<u>Lys</u>-Tyr-Val-Asp-<u>Asp</u>-Leu-Glu-Leu-Ser-Ala-(OH)NH$_2$ c138) RNH-Ser-Leu-Ala-Xaa$_3$-Asp-Thr-Pro-Thr-Xaa$_1$-Xaa$_2$-Phe-Xaa$_4$-Tyr-Thr-[linker]-Glu-  (SEQ ID NO:859)
Glu-Trp-Val-<u>Lys</u>-Tyr-Val-Asp-<u>Asp</u>-Leu-Glu-Leu-Ser-Ala-(OH)NH$_2$ c139) RNH-Ser-Leu-Ala-Ala-Xaa$_3$-Thr-Pro-Thr-Xaa$_1$-Xaa$_2$-Phe-Xaa$_4$-Tyr-Thr-[linker]-Glu-  (SEQ ID NO:860)
Glu-Trp-Val-<u>Lys</u>-Tyr-Val-Asp-<u>Asp</u>-Leu-Glu-Leu-Ser-Ala-(OH)NH$_2$ c140) RNH-Ser-Leu-Ala-Ala-Asp-Xaa$_3$-Pro-Thr-Xaa$_1$-Xaa$_2$-Phe-Xaa$_4$-Tyr-Thr-[linker]-Glu-  (SEQ ID NO:861)
Glu-Trp-Val-<u>Lys</u>-Tyr-Val-Asp-<u>Asp</u>-Leu-Glu-Leu-Ser-Ala-(OH)NH$_2$ c141) RNH-Ser-Leu-Ala-Ala-Asp-Thr-Xaa$_3$-Thr-Xaa$_1$-Xaa$_2$-Phe-Xaa$_4$-Tyr-Thr-[linker]-Glu-  (SEQ ID NO:862)
Glu-Trp-Val-<u>Lys</u>-Tyr-Val-Asp-<u>Asp</u>-Leu-Glu-Leu-Ser-Ala-(OH)NH$_2$ c142) RNH-Ser-Leu-Ala-Ala-Asp-Thr-Pro-Xaa$_3$-Xaa$_1$-Xaa$_2$-Phe-Xaa$_4$-Tyr-Thr-[linker]-Glu-  (SEQ ID NO:863)
Glu-Trp-Val-<u>Lys</u>-Tyr-Val-Asp-<u>Asp</u>-Leu-Glu-Leu-Ser-Ala-(OH)NH$_2$ c143) RNH-Ser-Leu-Ala-Ala-Asp-Thr-Pro-Thr-Xaa$_1$-Xaa$_2$-Phe-Ser-Xaa$_4$-Thr-[linker]-Glu-  (SEQ ID NO:864)
Glu-Trp-Val-<u>Lys</u>-Tyr-Val-Asp-<u>Asp</u>-Leu-Glu-Leu-Ser-Ala-(OH)NH$_2$ c144) RNH-Xaa$_3$-Leu-Ala-Ala-Asp-Thr-Pro-Thr-Xaa$_1$-Xaa$_2$-Phe-Ser-Xaa$_4$-Thr-[linker]-Glu-  (SEQ ID NO:865)
Glu-Trp-Val-<u>Lys</u>-Tyr-Val-Asp-<u>Asp</u>-Leu-Glu-Leu-Ser-Ala-(OH)NH$_2$ c145) RNH-Ser-Xaa$_3$-Ala-Ala-Asp-Thr-Pro-Thr-Xaa$_1$-Xaa$_2$-Phe-Ser-Xaa$_4$-Thr-[linker]-Glu-  (SEQ ID NO:866)
Glu-Trp-Val-<u>Lys</u>-Tyr-Val-Asp-<u>Asp</u>-Leu-Glu-Leu-Ser-Ala-(OH)NH$_2$ c146) RNH-Ser-Leu-Xaa$_3$-Ala-Asp-Thr-Pro-Thr-Xaa$_1$-Xaa$_2$-Phe-Ser-Xaa$_4$-Thr-[linker]-Glu-  (SEQ ID NO:867)
Glu-Trp-Val-<u>Lys</u>-Tyr-Val-Asp-<u>Asp</u>-Leu-Glu-Leu-Ser-Ala-(OH)NH$_2$ c147) RNH-Ser-Leu-Ala-Xaa$_3$-Asp-Thr-Pro-Thr-Xaa$_1$-Xaa$_2$-Phe-Ser-Xaa$_4$-Thr-[linker]-Glu-  (SEQ ID NO:868)
Glu-Trp-Val-<u>Lys</u>-Tyr-Val-Asp-<u>Asp</u>-Leu-Glu-Leu-Ser-Ala-(OH)NH$_2$ c148) RNH-Ser-Leu-Ala-Ala-Xaa$_3$-Thr-Pro-Thr-Xaa$_1$-Xaa$_2$-Phe-Ser-Xaa$_4$-Thr-[linker]-Glu-  (SEQ ID NO:869)
Glu-Trp-Val-<u>Lys</u>-Tyr-Val-Asp-<u>Asp</u>-Leu-Glu-Leu-Ser-Ala-(OH)NH$_2$ c149) RNH-Ser-Leu-Ala-Ala-Asp-Xaa$_3$-Pro-Thr-Xaa$_1$-Xaa$_2$-Phe-Ser-Xaa$_4$-Thr-[linker]-Glu-  (SEQ ID NO:870)
Glu-Trp-Val-<u>Lys</u>-Tyr-Val-Asp-<u>Asp</u>-Leu-Glu-Leu-Ser-Ala-(OH)NH$_2$ c150) RNH-Ser-Leu-Ala-Ala-Asp-Thr-Xaa$_3$-Thr-Xaa$_1$-Xaa$_2$-Phe-Ser-Xaa$_4$-Thr-[linker]-Glu-  (SEQ ID NO:871)
Glu-Trp-Val-<u>Lys</u>-Tyr-Val-Asp-<u>Asp</u>-Leu-Glu-Leu-Ser-Ala-(OH)NH$_2$ c151) RNH-Ser-Leu-Ala-Ala-Asp-Thr-Pro-Xaa$_3$-Xaa$_1$-Xaa$_2$-Phe-Ser-Xaa$_4$-Thr-[linker]-Glu-  (SEQ ID NO:872)
Glu-Trp-Val-<u>Lys</u>-Tyr-Val-Asp-<u>Asp</u>-Leu-Glu-Leu-Ser-Ala-(OH)NH$_2$ c152) RNH-Ser-Leu-Ala-Ala-Asp-Thr-Pro-Thr-Xaa$_1$-Xaa$_2$-Phe-Ser-Tyr-Xaa$_4$-[linker]-Glu-  (SEQ ID NO:873)
Glu-Trp-Val-<u>Lys</u>-Tyr-Val-Asp-<u>Asp</u>-Leu-Glu-Leu-Ser-Ala-(OH)NH$_2$ c153) RNH-Xaa$_3$-Leu-Ala-Ala-Asp-Thr-Pro-Thr-Xaa$_1$-Xaa$_2$-Phe-Ser-Tyr-Xaa$_4$-[linker]-Glu-  (SEQ ID NO:874)
Glu-Trp-Val-<u>Lys</u>-Tyr-Val-Asp-<u>Asp</u>-Leu-Glu-Leu-Ser-Ala-(OH)NH$_2$ -continued

| | | |
|---|---|---|
| c154) | RNH-Ser-Xaa₃-Ala-Ala-Asp-Thr-Pro-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:875) |
| c155) | RNH-Ser-Leu-Xaa₃-Ala-Asp-Thr-Pro-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:876) |
| c156) | RNH-Ser-Leu-Ala-Xaa₃-Asp-Thr-Pro-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:877) |
| c157) | RNH-Ser-Leu-Ala-Ala-Xaa₃-Thr-Pro-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:878) |
| c158) | RNH-Ser-Leu-Ala-Ala-Asp-Xaa₃-Pro-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:879) |
| c159) | RNH-Ser-Leu-Ala-Ala-Asp-Thr-Xaa₃-Thr-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:880) |
| c160) | RNH-Ser-Leu-Ala-Ala-Asp-Thr-Pro-Xaa₃-Xaa₁-Xaa₂-Phe-Ser-Tyr-Xaa₄-[linker]-Glu-Glu-Trp-Val-<u>Lys</u>-Tyr-Val-Asp-<u>Asp</u>-Leu-Glu-Leu-Ser-Ala-(OH)NH₂ | (SEQ ID NO:881) |

In the above structures:

R is selected from the group consisting of hydrogen, alkyl, alkenyl, alkynyl, alkylcarbonyl, arylcarbonyl, aryl, PEG (polyethyleneglycol) and any other modifying group.

Xaa₃ is selected from the group consisting of L-Pro, D-Pro, P*, Btd and any L- or D-natural and non-natural amino acid.

Xaa₄ is selected from the group consisting of P*, Btd and any L- or D-natural amino acid and any non-natural amino acid.

P* is:

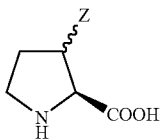

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, Orn to Asp. Moieties other than naturally occurring amino acids may also be substituted, such as Btd:

Btd* is:

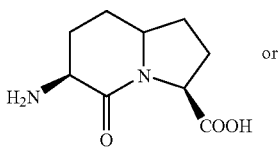

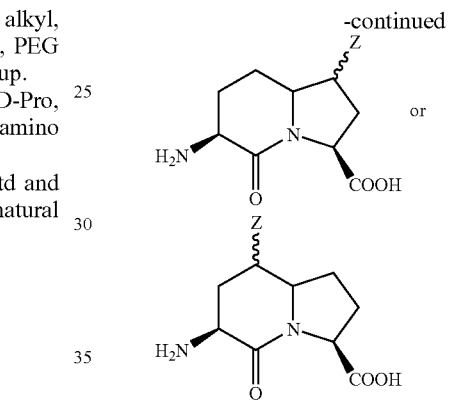

Z=hydrogen, alkyl, alkenyl, alkynyl, alkylcarbonyl, arylcarbonyl, aryl, aryl-hydroxy, and more Xaa₁ is selected from the group consisting of any L- or D-natural amino acid and any non-natural amino acid.

Xaa₂ is selected from the group consisting of any L- or D-natural amino acid and any non-natural amino acid.

The linker is a bifunctional group covalently attached to the N-terminal and C-terminal portions of the analog having the structure: $H_2N-Z_4-COOH$ wherein $Z_4$ is selected from the group consisting of: (1) alkyl, alkenyl, aralkyl, alkynyl; (2) $-(CH_2)_n-$ wherein n is an integer n=9 to 14; (3) any combination of four natural amino acids or non-natural amino acids; and (4) -(Gly)₄- (SEQ ID NO: 1640).

RANTES Compounds

Preferred embodiments of linear RANTES analogs of the present invention corresponding to a portion of the N-terminal region of RANTES having the following structures:

RANTES-(1–9) acid or amide
d1) RNH-Ser-Pro-Tyr-Ser-Ser-Asp-Thr-Thr-Pro-(OH)NH₂  (SEQ ID NO:882)

Preferred embodiments of linear RANTES analogs of the present invention corresponding to a portion of the internal region of RANTES having the following structures:

```
[A11]-RANTES-(11–33) acid or amide
d2)    RNH-Ala-Phe-Ala-Tyr-Ile-Ala-Arg-Pro-Leu-Pro-Arg-Ala-His-Ile-Lys-Glu-Tyr-Phe-    (SEQ ID NO:883)
       Tyr-Thr-Ser-Gly-Lys-(OH)NH2

RANTES-(35–49) acid or amide
d3)    RNH-Ser-Asn-Pro-Ala-Val-Val-Phe-Val-Thr-Arg-Lys-Asn-Arg-Gln-Val-(OH)NH2         (SEQ ID NO:884)
```

Preferred embodiments of linear RANTES analogs of the present invention corresponding to a portion of the N-terminal and a portion the internal region of RANTES having the following structures:

```
RANTES-(1–33) acid or amide
d4)    RNH-Ser-Pro-Tyr-Ser-Ser-Asp-Thr-Thr-Pro-Cys-Cys-Phe-Ala-Tyr-Ile-Ala-Arg-Pro-    (SEQ ID NO:885)
       Leu-Pro-Arg-Ala-His-Ile-Lys-Glu-Tyr-Phe-Tyr-Thr-Ser-Gly-Lys-(OH)NH2
```

Preferred embodiments of linear RANTES analogs of the present invention corresponding to a portion of the C-terminal region of RANTES having the following structures:

```
RANTES-(51–68) acid or amide
d5)    RNH-Ala-Asn-Pro-Glu-Lys-Lys-Trp-Val-Arg-Glu-Tyr-Ile-Asn-Ser-Leu-Glu-Met-Ser-    (SEQ ID NO:886)
       (OH)NH2
```

Preferred embodiments of linear RANTES analogs of the present invention corresponding to a portion of the N-terminal region joined with a linker to the C-terminal region of RANTES having the following structures:

```
RANTES-(1–14)-[linker]-RANTES-(54–68) acid or amide
d6)    RNH-Ser-Pro-Tyr-Ser-Ser-Asp-Thr-Thr-Pro-Cys-Cys-Phe-Ala-Tyr-[linker]-Glu-Lys-   (SEQ ID NO:887)
       Lys-Trp-Val-Arg-Glu-Tyr-Ile-Asn-Ser-Leu-Glu-Met-Ser-(OH)NH2 d7)    RNH-Xaa3-Pro-Tyr-Ser-Ser-Asp-Thr-Thr-Pro-Xaa1-Xaa2-Phe-Ala-Tyr-[linker]-Glu-    (SEQ ID NO:888)
       Lys-Lys-Trp-Val-Arg-Glu-Tyr-Ile-Asn-Ser-Leu-Glu-Met-Ser-(OH)NH2 d8)    RNH-Ser-Xaa3-Tyr-Ser-Ser-Asp-Thr-Thr-Pro-Xaa1-Xaa2-Phe-Ala-Tyr-[linker]-Glu-    (SEQ ID NO:889)
       Lys-Lys-Trp-Val-Arg-Glu-Tyr-Ile-Asn-Ser-Leu-Glu-Met-Ser-(OH)NH2 d9)    RNH-Ser-Pro-Xaa3-Ser-Ser-Asp-Thr-Thr-Pro-Xaa1-Xaa2-Phe-Ala-Tyr-[linker]-Glu-    (SEQ ID NO:890)
       Lys-Lys-Trp-Val-Arg-Glu-Tyr-Ile-Asn-Ser-Leu-Glu-Met-Ser-(OH)NH2 d10)   RNH-Ser-Pro-Tyr-Xaa3-Ser-Asp-Thr-Thr-Pro-Xaa1-Xaa2-Phe-Ala-Tyr-[linker]-Glu-    (SEQ ID NO:891)
       Lys-Lys-Trp-Val-Arg-Glu-Tyr-Ile-Asn-Ser-Leu-Glu-Met-Ser-(OH)NH2 d11)   RNH-Ser-Pro-Tyr-Ser-Xaa3-Asp-Thr-Thr-Pro-Xaa1-Xaa2-Phe-Ala-Tyr-[linker]-Glu-    (SEQ ID NO:892)
       Lys-Lys-Trp-Val-Arg-Glu-Tyr-Ile-Asn-Ser-Leu-Glu-Met-Ser-(OH)NH2 d12)   RNH-Ser-Pro-Tyr-Ser-Ser-Xaa3-Thr-Thr-Pro-Xaa1-Xaa2-Phe-Ala-Tyr-[linker]-Glu-    (SEQ ID NO:893)
       Lys-Lys-Trp-Val-Arg-Glu-Tyr-Ile-Asn-Ser-Leu-Glu-Met-Ser-(OH)NH2 d13)   RNH-Ser-Pro-Tyr-Ser-Ser-Asp-Xaa3-Thr-Pro-Xaa1-Xaa2-Phe-Ala-Tyr-[linker]-Glu-    (SEQ ID NO:894)
       Lys-Lys-Trp-Val-Arg-Glu-Tyr-Ile-Asn-Ser-Leu-Glu-Met-Ser-(OH)NH2 d14)   RNH-Ser-Pro-Tyr-Ser-Ser-Asp-Thr-Xaa3-Pro-Xaa1-Xaa2-Phe-Ala-Tyr-[linker]-Glu-    (SEQ ID NO:895)
       Lys-Lys-Trp-Val-Arg-Glu-Tyr-Ile-Asn-Ser-Leu-Glu-Met-Ser-(OH)NH2 d15)   RNH-Ser-Pro-Tyr-Ser-Ser-Asp-Thr-Thr-Xaa3-Xaa1-Xaa2-Phe-Ala-Tyr-[linker]-Glu-    (SEQ ID NO:896)
       Lys-Lys-Trp-Val-Arg-Glu-Tyr-Ile-Asn-Ser-Leu-Glu-Met-Ser-(OH)NH2 d16)   RNH-Ser-Pro-Tyr-Ser-Ser-Asp-Thr-Thr-Pro-Cys-Cys-Xaa4-Ala-Tyr-[linker]-Glu-      (SEQ ID NO:897)
       Lys-Lys-Trp-Val-Arg-Glu-Tyr-Ile-Asn-Ser-Leu-Glu-Met-Ser-(OH)NH2
```

-continued d17) RNH-Xaa₃-Pro-Tyr-Ser-Ser-Asp-Thr-Thr-Pro-Xaa₁-Xaa₂-Xaa₄-Ala-Tyr-[linker]-Glu- (SEQ ID NO:898)
Lys-Lys-Trp-Val-Arg-Glu-Tyr-Ile-Asn-Ser-Leu-Glu-Met-Ser-(OH)NH₂ d18) RNH-Ser-Xaa₃-Tyr-Ser-Ser-Asp-Thr-Thr-Pro-Xaa₁-Xaa₂-Xaa₄-Ala-Tyr-[linker]-Glu- (SEQ ID NO:899)
Lys-Lys-Trp-Val-Arg-Glu-Tyr-Ile-Asn-Ser-Leu-Glu-Met-Ser-(OH)NH₂ d19) RNH-Ser-Pro-Xaa₃-Ser-Ser-Asp-Thr-Thr-Pro-Xaa₁-Xaa₂-Xaa₄-Ala-Tyr-[linker]-Glu- (SEQ ID NO:900)
Lys-Lys-Trp-Val-Arg-Glu-Tyr-Ile-Asn-Ser-Leu-Glu-Met-Ser-(OH)NH₂ d20) RNH-Ser-Pro-Tyr-Xaa₃-Ser-Asp-Thr-Thr-Pro-Xaa₁-Xaa₂-Xaa₄-Ala-Tyr-[linker]-Glu- (SEQ ID NO:901)
Lys-Lys-Trp-Val-Arg-Glu-Tyr-Ile-Asn-Ser-Leu-Glu-Met-Ser-(OH)NH₂ d21) RNH-Ser-Pro-Tyr-Ser-Xaa₃-Asp-Thr-Thr-Pro-Xaa₁-Xaa₂-Xaa₄-Ala-Tyr-[linker]-Glu- (SEQ ID NO:902)
Lys-Lys-Trp-Val-Arg-Glu-Tyr-Ile-Asn-Ser-Leu-Glu-Met-Ser-(OH)NH₂ d22) RNH-Ser-Pro-Tyr-Ser-Ser-Xaa₃-Thr-Thr-Pro-Xaa₁-Xaa₂-Xaa₄-Ala-Tyr-[linker]-Glu- (SEQ ID NO:903)
Lys-Lys-Trp-Val-Arg-Glu-Tyr-Ile-Asn-Ser-Leu-Glu-Met-Ser-(OH)NH₂ d23) RNH-Ser-Pro-Tyr-Ser-Ser-Asp-Xaa₃-Thr-Pro-Xaa₁-Xaa₂-Xaa₄-Ala-Tyr-[linker]-Glu- (SEQ ID NO:904)
Lys-Lys-Trp-Val-Arg-Glu-Tyr-Ile-Asn-Ser-Leu-Glu-Met-Ser-(OH)NH₂ d24) RNH-Ser-Pro-Tyr-Ser-Ser-Asp-Thr-Xaa₃-Pro-Xaa₁-Xaa₂-Xaa₄-Ala-Tyr-[linker]-Glu- (SEQ ID NO:905)
Lys-Lys-Trp-Val-Arg-Glu-Tyr-Ile-Asn-Ser-Leu-Glu-Met-Ser-(OH)NH₂ d25) RNH-Ser-Pro-Tyr-Ser-Ser-Asp-Thr-Thr-Xaa₃-Xaa₁-Xaa₂-Xaa₄-Ala-Tyr-[linker]-Glu- (SEQ ID NO:906)
Lys-Lys-Trp-Val-Arg-Glu-Tyr-Ile-Asn-Ser-Leu-Glu-Met-Ser-(OH)NH₂ d26) RNH-Ser-Pro-Tyr-Ser-Ser-Asp-Thr-Thr-Pro-Cys-Cys-Phe-Xaa₄-Tyr-[linker]-Glu- (SEQ ID NO:907)
Lys-Lys-Trp-Val-Arg-Glu-Tyr-Ile-Asn-Ser-Leu-Glu-Met-Ser-(OH)NH₂ d27) RNH-Xaa₃-Pro-Tyr-Ser-Ser-Asp-Thr-Thr-Pro-Xaa₁-Xaa₂-Phe-Xaa₄-Tyr-[linker]-Glu- (SEQ ID NO:908)
Lys-Lys-Trp-Val-Arg-Glu-Tyr-Ile-Asn-Ser-Leu-Glu-Met-Ser-(OH)NH₂ d28) RNH-Ser-Xaa₃-Tyr-Ser-Ser-Asp-Thr-Thr-Pro-Xaa₁-Xaa₂-Phe-Xaa₄-Tyr-[linker]-Glu- (SEQ ID NO:909)
Lys-Lys-Trp-Val-Arg-Glu-Tyr-Ile-Asn-Ser-Leu-Glu-Met-Ser-(OH)NH₂ d29) RNH-Ser-Pro-Xaa₃-Ser-Ser-Asp-Thr-Thr-Pro-Xaa₁-Xaa₂-Phe-Xaa₄-Tyr-[linker]-Glu- (SEQ ID NO:910)
Lys-Lys-Trp-Val-Arg-Glu-Tyr-Ile-Asn-Ser-Leu-Glu-Met-Ser-(OH)NH₂ d30) RNH-Ser-Pro-Tyr-Xaa₃-Ser-Asp-Thr-Thr-Pro-Xaa₁-Xaa₂-Phe-Xaa₄-Tyr-[linker]-Glu- (SEQ ID NO:911)
Lys-Lys-Trp-Val-Arg-Glu-Tyr-Ile-Asn-Ser-Leu-Glu-Met-Ser-(OH)NH₂ d31) RNH-Ser-Pro-Tyr-Ser-Xaa₃-Asp-Thr-Thr-Pro-Xaa₁-Xaa₂-Phe-Xaa₄-Tyr-[linker]-Glu- (SEQ ID NO:912)
Lys-Lys-Trp-Val-Arg-Glu-Tyr-Ile-Asn-Ser-Leu-Glu-Met-Ser-(OH)NH₂ d32) RNH-Ser-Pro-Tyr-Ser-Ser-Xaa₃-Thr-Thr-Pro-Xaa₁-Xaa₂-Phe-Xaa₄-Tyr-[linker]-Glu- (SEQ ID NO:913)
Lys-Lys-Trp-Val-Arg-Glu-Tyr-Ile-Asn-Ser-Leu-Glu-Met-Ser-(OH)NH₂ d33) RNH-Ser-Pro-Tyr-Ser-Ser-Asp-Xaa₃-Thr-Pro-Xaa₁-Xaa₂-Phe-Xaa₄-Tyr-[linker]-Glu- (SEQ ID NO:914)
Lys-Lys-Trp-Val-Arg-Glu-Tyr-Ile-Asn-Ser-Leu-Glu-Met-Ser-(OH)NH₂ d34) RNH-Ser-Pro-Tyr-Ser-Ser-Asp-Thr-Xaa₃-Pro-Xaa₁-Xaa₂-Phe-Xaa₄-Tyr-[linker]-Glu- (SEQ ID NO:915)
Lys-Lys-Trp-Val-Arg-Glu-Tyr-Ile-Asn-Ser-Leu-Glu-Met-Ser-(OH)NH₂ d35) RNH-Ser-Pro-Tyr-Ser-Ser-Asp-Thr-Thr-Xaa₃-Xaa₁-Xaa₂-Phe-Xaa₄-Tyr-[linker]-Glu- (SEQ ID NO:916)
Lys-Lys-Trp-Val-Arg-Glu-Tyr-Ile-Asn-Ser-Leu-Glu-Met-Ser(OH)NH₂ d36) RNH-Ser-Pro-Tyr-Ser-Ser-Asp-Thr-Thr-Pro-Cys-Cys-Phe-Ala-Xaa₄-[linker]-Glu- (SEQ ID NO:917)
Lys-Lys-Trp-Val-Arg-Glu-Tyr-Ile-Asn-Ser-Leu-Glu-Met-Ser-(OH)NH₂ d37) RNH-Xaa₃-Pro-Tyr-Ser-Ser-Asp-Thr-Thr-Pro-Xaa₁-Xaa₂-Phe-Ala-Xaa₄-[linker]-Glu- (SEQ ID NO:918)
Lys-Lys-Trp-Val-Arg-Glu-Tyr-Ile-Asn-Ser-Leu-Glu-Met-Ser-(OH)NH₂ d38) RNH-Ser-Xaa₃-Tyr-Ser-Ser-Asp-Thr-Thr-Pro-Xaa₁-Xaa₂-Phe-Ala-Xaa₄-[linker]-Glu- (SEQ ID NO:919)
Lys-Lys-Trp-Val-Arg-Glu-Tyr-Ile-Asn-Ser-Leu-Glu-Met-Ser-(OH)NH₂ d39) RNH-Ser-Pro-Xaa₃-Ser-Ser-Asp-Thr-Thr-Pro-Xaa₁-Xaa₂-Phe-Ala-Xaa₄-[linker]-Glu- (SEQ ID NO:920)
Lys-Lys-Trp-Val-Arg-Glu-Tyr-Ile-Asn-Ser-Leu-Glu-Met-Ser-(OH)NH₂ d40) RNH-Ser-Pro-Tyr-Xaa₃-Ser-Asp-Thr-Thr-Pro-Xaa₁-Xaa₂-Phe-Ala-Xaa₄-[linker]-Glu- (SEQ ID NO:921)
Lys-Lys-Trp-Val-Arg-Glu-Tyr-Ile-Asn-Ser-Leu-Glu-Met-Ser-(OH)NH₂ d41) RNH-Ser-Pro-Tyr-Ser-Xaa₃-Asp-Thr-Thr-Pro-Xaa₁-Xaa₂-Phe-Ala-Xaa₄-[linker]-Glu- (SEQ ID NO:922)
Lys-Lys-Trp-Val-Arg-Glu-Tyr-Ile-Asn-Ser-Leu-Glu-Met-Ser-(OH)NH₂ d42) RNH-Ser-Pro-Tyr-Ser-Ser-Xaa₃-Thr-Thr-Pro-Xaa₁-Xaa₂-Phe-Ala-Xaa₄-[linker]-Glu- (SEQ ID NO:923)
Lys-Lys-Trp-Val-Arg-Glu-Tyr-Ile-Asn-Ser-Leu-Glu-Met-Ser-(OH)NH₂ d43) RNH-Ser-Pro-Tyr-Ser-Ser-Asp-Xaa₃-Thr-Pro-Xaa₁-Xaa₂-Phe-Ala-Xaa₄-[linker]-Glu- (SEQ ID NO:924)
Lys-Lys-Trp-Val-Arg-Glu-Tyr-Ile-Asn-Ser-Leu-Glu-Met-Ser-(OH)NH₂

-continued d44) RNH-Ser-Pro-Tyr-Ser-Ser-Asp-Thr-Xaa₃-Pro-Xaa₁-Xaa₂-Phe-Ala-Xaa₄-[linker]-Glu- (SEQ ID NO:925)
Lys-Lys-Trp-Val-Arg-Glu-Tyr-Ile-Asn-Ser-Leu-Glu-Met-Ser-(OH)NH₂ d45) RNH-Ser-Pro-Tyr-Ser-Ser-Asp-Thr-Thr-Xaa₃-Xaa₁-Xaa₂-Phe-Ala-Xaa₄-[linker]-Glu- (SEQ ID NO:926)
Lys-Lys-Trp-Val-Arg-Glu-Tyr-Ile-Asn-Ser-Leu-Glu-Met-Ser-(OH)NH₂

Preferred embodiments of cyclic RANTES analogs of the present invention corresponding to cyclic a portion of the internal region of RANTES having the following structures:

[Ala¹⁰]-RANTES-(10–34) cyclic(Cys11-Cys34) acid or amide
d46) RNH-Ala-<u>Cys</u>-Phe-Ala-Tyr-Ile-Ala-Arg-Pro-Leu-Pro-Arg-Ala-His-Ile-Lys-Glu-Tyr- (SEQ ID NO:927)
Phe-Tyr-Thr-Ser-Gly-Lys-<u>Cys</u>-(OH)NH₂

[Glu¹⁰]-RANTES-(10–33) cyclic(Glu11-Lys33) acid or amide
d47) RNH-<u>Glu</u>-Cys-Phe-Ala-Tyr-Ile-Ala-Arg-Pro-Leu-Pro-Arg-Ala-His-Ile-Lys-Glu-Tyr- (SEQ ID NO:928)
Phe-Tyr-Thr-Ser-Gly-<u>Lys</u>-(OH)NH₂

[Ala¹⁰]-RANTES-(10–34) cyclic(Glu26-Lys33) acid or amide
d48) RNH-Ala-Cys-Phe-Ala-Tyr-Ile-Ala-Arg-Pro-Leu-Pro-Arg-Ala-His-Ile-Lys-<u>Glu</u>-Tyr- (SEQ ID NO:929)
Phe-Tyr-Thr-Ser-Gly-<u>Lys</u>-(OH)NH₂

Preferred embodiments of cyclic RANTES analogs of the present invention corresponding to the N-terminal region and a cyclic a portion of the internal region of RANTES having the following structures:

RANTES-(1–33) cyclic(Glu26-Lys33) acid or amide
d49) RNH-Ser-Pro-Tyr-Ser-Ser-Asp-Thr-Thr-Pro-Cys-Cys-Phe-Ala-Tyr-Ile-Ala-Arg-Pro- (SEQ ID NO:930)
Leu-Pro-Arg-Ala-His-Ile-Lys-<u>Glu</u>-Tyr-Phe-Tyr-Thr-Ser-Gly-<u>Lys</u>-(OH)NH₂ d50) RNH-Ser-Pro-Tyr-Ser-Ser-Asp-Thr-Thr-Pro-Xaa₁-Xaa₂-Phe-Ala-Tyr-Ile-Ala-Arg-Pro- (SEQ ID NO:931)
Leu-Pro-Arg-Ala-His-Ile-Lys-<u>Glu</u>-Tyr-Phe-Tyr-Thr-Ser-Gly-<u>Lys</u>-(OH)NH₂

Preferred embodiments of cyclic RANTES analogs of the present invention corresponding to a portion of the N-terminal region joined with a linker to cyclic portion of the C-terminal region of RANTES having the following structures:

RANTES-(1–14)-[linker]-RANTES-(54–68) cyclic(Lys56-Glu60) acid or amide
d51) RNH-Ser-Pro-Tyr-Ser-Ser-Asp-Thr-Thr-Pro-Cys-Cys-Phe-Ala-Tyr-[linker]-Glu-Lys- (SEQ ID NO:932)
<u>Lys</u>-Trp-Val-Arg-<u>Glu</u>-Tyr-Ile-Asn-Ser-Leu-Glu-Met-Ser-(OH)NH₂ d52) RNH-Xaa₃-Pro-Tyr-Ser-Ser-Asp-Thr-Thr-Pro-Xaa₁-Xaa₂-Phe-Ala-Tyr-[linker]-Glu- (SEQ ID NO:933)
Lys-<u>Lys</u>-Trp-Val-Arg-<u>Glu</u>-Tyr-Ile-Asn-Ser-Leu-Glu-Met-Ser-(OH)NH₂ d53) RNH-Ser-Xaa₃-Tyr-Ser-Ser-Asp-Thr-Thr-Pro-Xaa₁-Xaa₂-Phe-Ala-Tyr-[linker]-Glu- (SEQ ID NO:934)
Lys-<u>Lys</u>-Trp-Val-Arg-<u>Glu</u>-Tyr-Ile-Asn-Ser-Leu-Glu-Met-Ser-(OH)NH₂ d54) RNH-Ser-Pro-Xaa₃-Ser-Ser-Asp-Thr-Thr-Pro-Xaa₁-Xaa₂-Phe-Ala-Tyr-[linker]-Glu- (SEQ ID NO:935)
Lys-<u>Lys</u>-Trp-Val-Arg-<u>Glu</u>-Tyr-Ile-Asn-Ser-Leu-Glu-Met-Ser-(OH)NH₂ d55) RNH-Ser-Pro-Tyr-Xaa₃-Ser-Asp-Thr-Thr-Pro-Xaa₁-Xaa₂-Phe-Ala-Tyr-[linker]-Glu- (SEQ ID NO:936)
Lys-<u>Lys</u>-Trp-Val-Arg-<u>Glu</u>-Tyr-Ile-Asn-Ser-Leu-Glu-Met-Ser-(OH)NH₂ d56) RNH-Ser-Pro-Tyr-Ser-Xaa₃-Asp-Thr-Thr-Pro-Xaa₁-Xaa₂-Phe-Ala-Tyr-[linker]-Glu- (SEQ ID NO:937)
Lys-<u>Lys</u>-Trp-Val-Arg-<u>Glu</u>-Tyr-Ile-Asn-Ser-Leu-Glu-Met-Ser-(OH)NH₂ d57) RNH-Ser-Pro-Tyr-Ser-Ser-Xaa₃-Thr-Thr-Pro-Xaa₁-Xaa₂-Phe-Ala-Tyr-[linker]-Glu- (SEQ ID NO:938)
Lys-<u>Lys</u>-Trp-Val-Arg-<u>Glu</u>-Tyr-Ile-Asn-Ser-Leu-Glu-Met-Ser-(OH)NH₂ d58) RNH-Ser-Pro-Tyr-Ser-Ser-Asp-Xaa₃-Thr-Pro-Xaa₁-Xaa₂-Phe-Ala-Tyr-[linker]-Glu- (SEQ ID NO:939)
Lys-<u>Lys</u>-Trp-Val-Arg-<u>Glu</u>-Tyr-Ile-Asn-Ser-Leu-Glu-Met-Ser-(OH)NH₂ d59) RNH-Ser-Pro-Tyr-Ser-Ser-Asp-Thr-Xaa₃-Pro-Xaa₁-Xaa₂-Phe-Ala-Tyr-[linker]-Glu- (SEQ ID NO:940)
Lys-<u>Lys</u>-Trp-Val-Arg-<u>Glu</u>-Tyr-Ile-Asn-Ser-Leu-Glu-Met-Ser-(OH)NH₂

-continued d60) RNH-Ser-Pro-Tyr-Ser-Ser-Asp-Thr-Thr-Xaa$_3$-Xaa$_1$-Xaa$_2$-Phe-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:941)

d61) RNH-Ser-Pro-Tyr-Ser-Ser-Asp-Thr-Thr-Pro-Cys-Cys-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:942)

d62) RNH-Xaa$_3$-Pro-Tyr-Ser-Ser-Asp-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:943)

d63) RNH-Ser-Xaa$_3$-Tyr-Ser-Ser-Asp-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:944)

d64) RNH-Ser-Pro-Xaa$_3$-Ser-Ser-Asp-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:945)

d65) RNH-Ser-Pro-Tyr-Xaa$_3$-Ser-Asp-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:946)

d66) RNH-Ser-Pro-Tyr-Ser-Xaa$_3$-Asp-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:947)

d67) RNH-Ser-Pro-Tyr-Ser-Ser-Xaa$_3$-Thr-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:948)

d68) RNH-Ser-Pro-Tyr-Ser-Ser-Asp-Xaa$_3$-Thr-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:949)

d69) RNH-Ser-Pro-Tyr-Ser-Ser-Asp-Thr-Xaa$_3$-Pro-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:950)

d70) RNH-Ser-Pro-Tyr-Ser-Ser-Asp-Thr-Thr-Xaa$_3$-Xaa$_1$-Xaa$_2$-Xaa$_4$-Ala-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:951)

d71) RNH-Ser-Pro-Tyr-Ser-Ser-Asp-Thr-Thr-Pro-Cys-Cys-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:952)

d72) RNH-Xaa$_3$-Pro-Tyr-Ser-Ser-Asp-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:953)

d73) RNH-Ser-Xaa$_3$-Tyr-Ser-Ser-Asp-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:954)

d74) RNH-Ser-Pro-Xaa$_3$-Ser-Ser-Asp-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:955)

d75) RNH-Ser-Pro-Tyr-Xaa$_3$-Ser-Asp-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:956)

d76) RNH-Ser-Pro-Tyr-Ser-Xaa$_3$-Asp-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:957)

d77) RNH-Ser-Pro-Tyr-Ser-Ser-Xaa$_3$-Thr-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:958)

d78) RNH-Ser-Pro-Tyr-Ser-Ser-Asp-Xaa$_3$-Thr-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:959)

d79) RNH-Ser-Pro-Tyr-Ser-Ser-Asp-Thr-Xaa$_3$-Pro-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:960)

d80) RNH-Ser-Pro-Tyr-Ser-Ser-Asp-Thr-Thr-Xaa$_3$-Xaa$_1$-Xaa$_2$-Phe-Xaa$_4$-Tyr-[linker]-Glu-Lys-Lys-Trp-Val-Arg-Glu-Tyr-Ile-Asn-Ser-Leu-Glu-Met-Ser-(OH)NH$_2$ (SEQ ID NO:961)

d81) RNH-Ser-Pro-Tyr-Ser-Ser-Asp-Thr-Thr-Pro-Cys-Cys-Phe-Ala-Xaa$_4$-[linker]-Glu-Lys-Lys-Trp-Val-Arg-Glu-Tyr-Ile-Asn-Ser-Leu-Glu-Met-Ser-(OH)NH$_2$ (SEQ ID NO:962)

d82) RNH-Xaa$_3$-Pro-Tyr-Ser-Ser-Asp-Thr-Thr-Pro-Xaa$_1$-Xaa$_2$-Phe-Ala-Xaa$_4$-[linker]-Glu-Lys-Lys-Trp-Val-Arg-Glu-Tyr-Ile-Asn-Ser-Leu-Glu-Met-Ser-(OH)NH$_2$ (SEQ ID NO:963)

d83) RNH-Ser-Xaa$_3$-Tyr-Ser-Ser-Asp-Thr-Thr-Pro-Xaa$_1$-Xaa$_2$-Phe-Ala-Xaa$_4$-[linker]-Glu-Lys-Lys-Trp-Val-Arg-Glu-Tyr-Ile-Asn-Ser-Leu-Glu-Met-Ser-(OH)NH$_2$ (SEQ ID NO:964)

d84) RNH-Ser-Pro-Xaa$_3$-Ser-Ser-Asp-Thr-Thr-Pro-Xaa$_1$-Xaa$_2$-Phe-Ala-Xaa$_4$-[linker]-Glu-Lys-Lys-Trp-Val-Arg-Glu-Tyr-Ile-Asn-Ser-Leu-Glu-Met-Ser-(OH)NH$_2$ (SEQ ID NO:965)

d85) RNH-Ser-Pro-Tyr-Xaa$_3$-Ser-Asp-Thr-Thr-Pro-Xaa$_1$-Xaa$_2$-Phe-Ala-Xaa$_4$-[linker]-Glu-Lys-Lys-Trp-Val-Arg-Glu-Tyr-Ile-Asn-Ser-Leu-Glu-Met-Ser-(OH)NH$_2$ (SEQ ID NO:966)

-continued

```
d86)  RNH-Ser-Pro-Tyr-Ser-Xaa₃-Asp-Thr-Thr-Pro-Xaa₁-Xaa₂-Phe-Ala-Xaa₄-[linker]-Glu-     (SEQ ID NO:967)
      Lys-Lys-Trp-Val-Arg-Glu-Tyr-Ile-Asn-Ser-Leu-Glu-Met-Ser-(OH)NH₂ d87)  RNH-Ser-Pro-Tyr-Ser-Ser-Xaa₃-Thr-Thr-Pro-Xaa₁-Xaa₂-Phe-Ala-Xaa₄-[linker]-Glu-     (SEQ ID NO:968)
      Lys-Lys-Trp-Val-Arg-Glu-Tyr-Ile-Asn-Ser-Leu-Glu-Met-Ser-(OH)NH₂ d88)  RNH-Ser-Pro-Tyr-Ser-Ser-Asp-Xaa₃-Thr-Pro-Xaa₁-Xaa₂-Phe-Ala-Xaa₄-[linker]-Glu-     (SEQ ID NO:969)
      Lys-Lys-Trp-Val-Arg-Glu-Tyr-Ile-Asn-Ser-Leu-Glu-Met-Ser-(OH)NH₂ d89)  RNH-Ser-Pro-Tyr-Ser-Ser-Asp-Thr-Xaa₃-Pro-Xaa₁-Xaa₂-Phe-Ala-Xaa₄-[linker]-Glu-     (SEQ ID NO:970)
      Lys-Lys-Trp-Val-Arg-Glu-Tyr-Ile-Asn-Ser-Leu-Glu-Met-Ser-(OH)NH₂ d90)  RNH-Ser-Pro-Tyr-Ser-Ser-Asp-Thr-Thr-Xaa₃-Xaa₁-Xaa₂-Phe-Ala-Xaa₄-[linker]-Glu-     (SEQ ID NO:971)
      Lys-Lys-Trp-Val-Arg-Glu-Tyr-Ile-Asn-Ser-Leu-Glu-Met-Ser-(OH)NH₂
```

In the above structures:

R is selected from the group consisting of hydrogen, alkyl, alkenyl, alkynyl, alkylcarbonyl, arylcarbonyl, aryl, PEG (polyethyleneglycol) and any other modifying group.

$Xaa_3$ is selected from the group consisting of L-Pro, D-Pro, P*, Btd and any L- or D-natural and non-natural amino acid.

$Xaa_4$ is selected from the group consisting of P*, Btd and any L- or D-natural amino acid and any non-natural amino acid.

P* is:

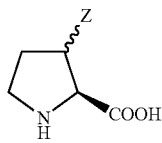

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, Orn to Asp. Moieties other than naturally occurring amino acids may also be substituted, such as Btd:

Btd* is:

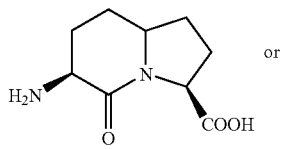

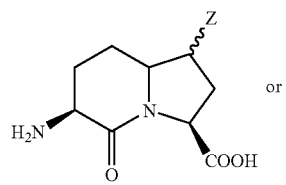

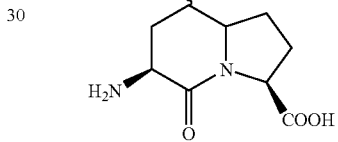

Z=hydrogen, alkyl, alkenyl, alkynyl, alkylcarbonyl, arylcarbonyl, aryl, aryl-hydroxy, and more $Xaa_1$ is selected from the group consisting of any L- or D-natural amino acid and any non-natural amino acid.

$Xaa_2$ is selected from the group consisting of any L- or D-natural amino acid and any non-natural amino acid.

The linker is a bifunctional group covalently attached to the N-terminal and C-terminal portions of the analog having the structure: $H_2N-Z_4-COOH$ wherein $Z_4$ is selected from the group consisting of: (1) alkyl, alkenyl, aralkyl, alkynyl; (2) —$(CH_2)_n$— wherein n is an integer n=9 to 14; (3) any combination of four natural amino acids or non-natural amino acids; and (4) -(Gly)₄- (SEQ ID NO: 1640).

I-309 Compounds

Preferred embodiments of linear I-309 analogs of the present invention corresponding to a portion of the N-terminal region of I-309 having the following structures:

[Ala¹⁰]-I-309-(1–10) acid or amide
```
e1) RNH-Lys-Ser-Met-Gln-Val-Pro-Phe-Ser-Arg-Ala-(OH)NH₂     (SEQ ID NO:972)
```

Preferred embodiments of linear I-309 analogs of the present invention corresponding to a portion of the internal region of I-309 having the following structures:

```
[Ala¹¹]-I-309-(11–25) acid or amide
e2)   RNH-Ala-Phe-Ser-Phe-Ala-Glu-Gln-Glu-Ile-Pro-Leu-Arg-Ala-Ile-Leu-(OH)NH₂           (SEQ ID NO:973)

[Ala¹¹]-I-309-(11–33) acid or amide
e3)   RNH-Ala-Phe-Ser-Phe-Ala-Glu-Gln-Glu-Ile-Pro-Leu-Arg-Ala-Ile-Leu-Cys-Tyr-Arg-      (SEQ ID NO:974)
      Asn-Thr-Ser-Ser-Ile-(OH)NH₂

[A²⁶]-I-309-(26–48) acid or amide
e4)   RNH-Ala-Tyr-Arg-Asn-Thr-Ser-Ser-Ile-Cys-Ser-Asn-Glu-Gly-Leu-Ile-Phe-Lys-Leu-      (SEQ ID NO:975)
      Lys-Arg-Gly-Lys-Glu-Ala-(OH)NH₂
```

Preferred embodiments of linear I-309 analogs of the present invention corresponding to a portion of the N-terminal region and a portion of the internal region of I-309 having the following structures:

```
I-309-(1–25) acid or amide
e5)   RNH-Lys-Ser-Met-Gln-Val-Pro-Phe-Ser-Arg-Cys-Cys-Phe-Ser-Phe-Ala-Glu-Gln-Glu-      (SEQ ID NO:976)
      Ile-Pro-Leu-Arg-Ala-Ile-Leu-(OH)NH₂ e6)   RNH-Lys-Ser-Met-Gln-Val-Pro-Phe-Ser-Arg-Xaa₁-Xaa₂-Phe-Ser-Phe-Ala-Glu-Gln-        (SEQ ID NO:977)
      Glu-Ile-Pro-Leu-Arg-Ala-Ile-Leu-(OH)NH₂ e7)   RNH-Xaa₃-Ser-Met-Gln-Val-Pro-Phe-Ser-Arg-Xaa₁-Xaa₂-Phe-Ser-Phe-Ala-Glu-Gln-       (SEQ ID NO:978)
      Glu-Ile-Pro-Leu-Arg-Ala-Ile-Leu-(OH)NH₂ e8)   RNH-Lys-Xaa₃-Met-Gln-Val-Pro-Phe-Ser-Arg-Xaa₁-Xaa₂-Phe-Ser-Phe-Ala-Glu-Gln-       (SEQ ID NO:979)
      Glu-Ile-Pro-Leu-Arg-Ala-Ile-Leu-(OH)NH₂ e9)   RNH-Lys-Ser-Xaa₃-Gln-Val-Pro-Phe-Ser-Arg-Xaa₁-Xaa₂-Phe-Ser-Phe-Ala-Glu-Gln-       (SEQ ID NO:980)
      Glu-Ile-Pro-Leu-Arg-Ala-Ile-Leu-(OH)NH₂ e10)  RNH-Lys-Ser-Met-Xaa₃-Val-Pro-Phe-Ser-Arg-Xaa₁-Xaa₂-Phe-Ser-Phe-Ala-Glu-Gln-       (SEQ ID NO:981)
      Glu-Ile-Pro-Leu-Arg-Ala-Ile-Leu-(OH)NH₂ e11)  RNH-Lys-Ser-Met-Gln-Xaa₃-Pro-Phe-Ser-Arg-Xaa₁-Xaa₂-Phe-Ser-Phe-Ala-Glu-Gln-       (SEQ ID NO:982)
      Glu-Ile-Pro-Leu-Arg-Ala-Ile-Leu-(OH)NH₂ e12)  RNH-Lys-Ser-Met-Gln-Val-Xaa₃-Phe-Ser-Arg-Xaa₁-Xaa₂-Phe-Ser-Phe-Ala-Glu-Gln-       (SEQ ID NO:983)
      Glu-Ile-Pro-Leu-Arg-Ala-Ile-Leu-(OH)NH₂ e13)  RNH-Lys-Ser-Met-Gln-Val-Pro-Xaa₃-Ser-Arg-Xaa₁-Xaa₂-Phe-Ser-Phe-Ala-Glu-Gln-       (SEQ ID NO:984)
      Glu-Ile-Pro-Leu-Arg-Ala-Ile-Leu-(OH)NH₂ e14)  RNH-Lys-Ser-Met-Gln-Val-Pro-Phe-Xaa₃-Arg-Xaa₁-Xaa₂-Phe-Ser-Phe-Ala-Glu-Gln-       (SEQ ID NO:985)
      Glu-Ile-Pro-Leu-Arg-Ala-Ile-Leu-(OH)NH₂ e15)  RNH-Lys-Ser-Met-Gln-Val-Pro-Phe-Ser-Xaa₃-Xaa₁-Xaa₂-Phe-Ser-Phe-Ala-Glu-Gln-       (SEQ ID NO:986)
      Glu-Ile-Pro-Leu-Arg-Ala-Ile-Leu-(OH)NH₂
```

Preferred embodiments of linear I-309 analogs of the present invention corresponding to a portion of the C-terminal region of I-309 having the following structures:

```
[Ala³⁴]-I-309-(34–67) acid or amide
e16)  RNH-Ala-Ser-Asn-Glu-Gly-Leu-Ile-Phe-Lys-Leu-Lys-Arg-Gly-Lys-Glu-Ala-Cys-Ala-     (SEQ ID NO:987)
      Leu-Asp-Thr-Val-Gly-Trp-Val-Gln-Arg-His-Arg-Lys-Met-Leu-Arg-His-(OH)NH₂

[Ala⁴⁹]-I-309-(48–73) acid or amide
e17)  RNH-Ala-Ala-Leu-Asp-Thr-Val-Gly-Trp-Val-Gln-Arg-His-Arg-Lys-Met-Leu-Arg-His-     (SEQ ID NO:988)
      Cys-Pro-Ser-Lys-Arg-Lys-(OH)NH₂
```

Preferred embodiments of linear I-309 analogs of the present invention corresponding to a portion the N-terminal region joined with a linker to the C-terminal region of I-309 having the following structures:

I-309-(1—14)-[linker]-I-309-(52—64) acid or amide e18) RNH-Lys-Ser-Met-Gln-Val-Pro-Phe-Ser-Arg-Cys-Cys-Phe-Ser-Phe-[linker]-Thr-Val- (SEQ ID NO:989)
Gly-Trp-Val-Gln-Arg-His-Arg-Lys-Met-Leu-Arg-(OH)NH$_2$ e19) RNH-Lys-Ser-Met-Gln-Val-Pro-Phe-Ser-Arg-Xaa$_1$-Xaa$_2$-Phe-Ser-Phe-[linker]-Thr- (SEQ ID NO:990)
Val-Gly-Trp-Val-Gln-Arg-His-Arg-Lys-Met-Leu-Arg-(OH)NH$_2$ e20) RNH-Xaa$_3$-Ser-Met-Gln-Val-Pro-Phe-Ser-Arg-Xaa$_1$-Xaa$_2$-Phe-Ser-Phe-[linker]-Thr- (SEQ ID NO:991)
Val-Gly-Trp-Val-Gln-Arg-His-Arg-Lys-Met-Leu-Arg-(OH)NH$_2$ e21) RNH-Lys-Xaa$_3$-Met-Gln-Val-Pro-Phe-Ser-Arg-Xaa$_1$-Xaa$_2$-Phe-Ser-Phe-[linker]-Thr- (SEQ ID NO:992)
Val-Gly-Trp-Val-Gln-Arg-His-Arg-Lys-Met-Leu-Arg-(OH)NH$_2$ e22) RNH-Lys-Ser-Xaa$_3$-Gln-Val-Pro-Phe-Ser-Arg-Xaa$_1$-Xaa$_2$-Phe-Ser-Phe-[linker]-Thr- (SEQ ID NO:993)
Val-Gly-Trp-Val-Gln-Arg-His-Arg-Lys-Met-Leu-Arg-(OH)NH$_2$ e23) RNH-Lys-Ser-Met-Xaa$_3$-Val-Pro-Phe-Ser-Arg-Xaa$_1$-Xaa$_2$-Phe-Ser-Phe-[linker]-Thr- (SEQ ID NO:994)
Val-Gly-Trp-Val-Gln-Arg-His-Arg-Lys-Met-Leu-Arg-(OH)NH$_2$ e25) RNH-Lys-Ser-Met-Gln-Xaa$_3$-Pro-Phe-Ser-Arg-Xaa$_1$-Xaa$_2$-Phe-Ser-Phe-[linker]-Thr- (SEQ ID NO:995)
Val-Gly-Trp-Val-Gln-Arg-His-Arg-Lys-Met-Leu-Arg-(OH)NH$_2$ e26) RNH-Lys-Ser-Met-Gln-Val-Xaa$_3$-Phe-Ser-Arg-Xaa$_1$-Xaa$_2$-Phe-Ser-Phe-[linker]-Thr- (SEQ ID NO:996)
Val-Gly-Trp-Val-Gln-Arg-His-Arg-Lys-Met-Leu-Arg-(OH)NH$_2$ e27) RNH-Lys-Ser-Met-Gln-Val-Pro-Xaa$_3$-Ser-Arg-Xaa$_1$-Xaa$_2$-Phe-Ser-Phe-[linker]-Thr- (SEQ ID NO:997)
Val-Gly-Trp-Val-Gln-Arg-His-Arg-Lys-Met-Leu-Arg-(OH)NH$_2$ e28) RNH-Lys-Ser-Met-Gln-Val-Pro-Phe-Xaa$_3$-Arg-Xaa$_1$-Xaa$_2$-Phe-Ser-Phe-[linker]-Thr- (SEQ ID NO:998)
Val-Gly-Trp-Val-Gln-Arg-His-Arg-Lys-Met-Leu-Arg-(OH)NH$_2$ e29) RNH-Lys-Ser-Met-Gln-Val-Pro-Phe-Ser-Xaa$_3$-Xaa$_1$-Xaa$_2$-Phe-Ser-Phe-[linker]-Thr- (SEQ ID NO:999)
Val-Gly-Trp-Val-Gln-Arg-His-Arg-Lys-Met-Leu-Arg-(OH)NH$_2$ e30) RNH-Lys-Ser-Met-Gln-Val-Pro-Phe-Ser-Arg-Cys-Cys-Xaa$_4$-Ser-Phe-[linker]-Thr- (SEQ ID NO:1000)
Val-Gly-Trp-Val-Gln-Arg-His-Arg-Lys-Met-Leu-Arg-(OH)NH$_2$ e31) RNH-Lys-Ser-Met-Gln-Val-Pro-Phe-Ser-Arg-Xaa$_1$-Xaa$_2$-Xaa$_4$-Ser-Phe-[linker]-Thr- (SEQ ID NO:1001)
Val-Gly-Trp-Val-Gln-Arg-His-Arg-Lys-Met-Leu-Arg-(OH)NH$_2$ e32) RNH-Xaa$_3$-Ser-Met-Gln-Val-Pro-Phe-Ser-Arg-Xaa$_1$-Xaa$_2$-Xaa$_4$-Ser-Phe-[linker]-Thr- (SEQ ID NO:1002)
Val-Gly-Trp-Val-Gln-Arg-His-Arg-Lys-Met-Leu-Arg-(OH)NH$_2$ e33) RNH-Lys-Xaa$_3$-Met-Gln-Val-Pro-Phe-Ser-Arg-Xaa$_1$-Xaa$_2$-Xaa$_4$-Ser-Phe-[linker]-Thr- (SEQ ID NO:1003)
Val-Gly-Trp-Val-Gln-Arg-His-Arg-Lys-Met-Leu-Arg-(OH)NH$_2$ e34) RNH-Lys-Ser-Xaa$_3$-Gln-Val-Pro-Phe-Ser-Arg-Xaa$_1$-Xaa$_2$-Xaa$_4$-Ser-Phe-[linker]-Thr- (SEQ ID NO:1004)
Val-Gly-Trp-Val-Gln-Arg-His-Arg-Lys-Met-Leu-Arg-(OH)NH$_2$ e35) RNH-Lys-Ser-Met-Xaa$_3$-Val-Pro-Phe-Ser-Arg-Xaa$_1$-Xaa$_2$-Xaa$_4$-Ser-Phe-[linker]-Thr- (SEQ ID NO:1005)
Val-Gly-Trp-Val-Gln-Arg-His-Arg-Lys-Met-Leu-Arg-(OH)NH$_2$ e36) RNH-Lys-Ser-Met-Gln-Xaa$_3$-Pro-Phe-Ser-Arg-Xaa$_1$-Xaa$_2$-Xaa$_4$-Ser-Phe-[linker]-Thr- (SEQ ID NO:1006)
Val-Gly-Trp-Val-Gln-Arg-His-Arg-Lys-Met-Leu-Arg-(OH)NH$_2$ e37) RNH-Lys-Ser-Met-Gln-Val-Xaa$_3$-Phe-Ser-Arg-Xaa$_1$-Xaa$_2$-Xaa$_4$-Ser-Phe-[linker]-Thr- (SEQ ID NO:1007)
Val-Gly-Trp-Val-Gln-Arg-His-Arg-Lys-Met-Leu-Arg-(OH)NH$_2$ e38) RNH-Lys-Ser-Met-Gln-Val-Pro-Xaa$_3$-Ser-Arg-Xaa$_1$-Xaa$_2$-Xaa$_4$-Ser-Phe-[linker]-Thr- (SEQ ID NO:1008)
Val-Gly-Trp-Val-Gln-Arg-His-Arg-Lys-Met-Leu-Arg-(OH)NH$_2$ e39) RNH-Lys-Ser-Met-Gln-Val-Pro-Phe-Xaa$_3$-Arg-Xaa$_1$-Xaa$_2$-Xaa$_4$-Ser-Phe-[linker]-Thr- (SEQ ID NO:1009)
Val-Gly-Trp-Val-Gln-Arg-His-Arg-Lys-Met-Leu-Arg-(OH)NH$_2$ e40) RNH-Lys-Ser-Met-Gln-Val-Pro-Phe-Ser-Xaa$_3$-Xaa$_1$-Xaa$_2$-Xaa$_4$-Ser-Phe-[linker]-Thr- (SEQ ID NO:1010)
Val-Gly-Trp-Val-Gln-Arg-His-Arg-Lys-Met-Leu-Arg-(OH)NH$_2$ e41) RNH-Lys-Ser-Met-Gln-Val-Pro-Phe-Ser-Arg-Cys-Cys-Phe-Xaa$_4$-Phe-[linker]-Thr- (SEQ ID NO:1011)
Val-Gly-Trp-Val-Gln-Arg-His-Arg-Lys-Met-Leu-Arg-(OH)NH$_2$ e42) RNH-Lys-Ser-Met-Gln-Val-Pro-Phe-Ser-Arg-Xaa$_1$-Xaa$_2$-Phe-Xaa$_4$-Phe-[linker]-Thr- (SEQ ID NO:1012)
Val-Gly-Trp-Val-Gln-Arg-His-Arg-Lys-Met-Leu-Arg-(OH)NH$_2$ e43) RNH-Xaa$_3$-Ser-Met-Gln-Val-Pro-Phe-Ser-Arg-Xaa$_1$-Xaa$_2$-Phe-Xaa$_4$-Phe-[linker]-Thr- (SEQ ID NO:1013)
Val-Gly-Trp-Val-Gln-Arg-His-Arg-Lys-Met-Leu-Arg-(OH)NH$_2$ e44) RNH-Lys-Xaa$_3$-Met-Gln-Val-Pro-Phe-Ser-Arg-Xaa$_1$-Xaa$_2$-Phe-Xaa$_4$-Phe-[linker]-Thr- (SEQ ID NO:1014)
Val-Gly-Trp-Val-Gln-Arg-His-Arg-Lys-Met-Leu-Arg-(OH)NH$_2$

```
e45)  RNH-Lys-Ser-Xaa₃-Gln-Val-Pro-Phe-Ser-Arg-Xaa₁-Xaa₂-Phe-Xaa₄-Phe-[linker]-Thr-      (SEQ ID NO:1015)
      Val-Gly-Trp-Val-Gln-Arg-His-Arg-Lys-Met-Leu-Arg-(OH)NH₂ e46)  RNH-Lys-Ser-Met-Xaa₃-Val-Pro-Phe-Ser-Arg-Xaa₁-Xaa₂-Phe-Xaa₄-Phe-[linker]-Thr-      (SEQ ID NO:1016)
      Val-Gly-Trp-Val-Gln-Arg-His-Arg-Lys-Met-Leu-Arg-(OH)NH₂ e47)  RNH-Lys-Ser-Met-Gln-Xaa₃-Pro-Phe-Ser-Arg-Xaa₁-Xaa₂-Phe-Xaa₄-Phe-[linker]-Thr-      (SEQ ID NO:1017)
      Val-Gly-Trp-Val-Gln-Arg-His-Arg-Lys-Met-Leu-Arg-(OH)NH₂ e48)  RNH-Lys-Ser-Met-Gln-Val-Xaa₃-Phe-Ser-Arg-Xaa₁-Xaa₂-Phe-Xaa₄-Phe-[linker]-Thr-      (SEQ ID NO:1018)
      Val-Gly-Trp-Val-Gln-Arg-His-Arg-Lys-Met-Leu-Arg-(OH)NH₂ e49)  RNH-Lys-Ser-Met-Gln-Val-Pro-Xaa₃-Ser-Arg-Xaa₁-Xaa₂-Phe-Xaa₄-Phe-[linker]-Thr-      (SEQ ID NO:1019)
      Val-Gly-Trp-Val-Gln-Arg-His-Arg-Lys-Met-Leu-Arg-(OH)NH₂ e50)  RNH-Lys-Ser-Met-Gln-Val-Pro-Phe-Xaa₃-Arg-Xaa₁-Xaa₂-Phe-Xaa₄-Phe-[linker]-Thr-      (SEQ ID NO:1020)
      Val-Gly-Trp-Val-Gln-Arg-His-Arg-Lys-Met-Leu-Arg-(OH)NH₂ e51)  RNH-Lys-Ser-Met-Gln-Val-Pro-Phe-Ser-Xaa₃-Xaa₁-Xaa₂-Phe-Xaa₄-Phe-[linker]-Thr-      (SEQ ID NO:1021)
      Val-Gly-Trp-Val-Gln-Arg-His-Arg-Lys-Met-Leu-Arg-(OH)NH₂ e52)  RNH-Lys-Ser-Met-Gln-Val-Pro-Phe-Ser-Arg-Cys-Cys-Phe-Ser-Xaa₄-[linker]-Thr-         (SEQ ID NO:1022)
      Val-Gly-Trp-Val-Gln-Arg-His-Arg-Lys-Met-Leu-Arg-(OH)NH₂ e53)  RNH-Lys-Ser-Met-Gln-Val-Pro-Phe-Ser-Arg-Xaa₁-Xaa₂-Phe-Ser-Xaa₄-[linker]-Thr-       (SEQ ID NO:1023)
      Val-Gly-Trp-Val-Gln-Arg-His-Arg-Lys-Met-Leu-Arg-(OH)NH₂ e54)  RNH-Xaa₃-Ser-Met-Gln-Val-Pro-Phe-Ser-Arg-Xaa₁-Xaa₂-Phe-Ser-Xaa₄-[linker]-Thr-      (SEQ ID NO:1024)
      Val-Gly-Trp-Val-Gln-Arg-His-Arg-Lys-Met-Leu-Arg-(OH)NH₂ e55)  RNH-Lys-Xaa₃-Met-Gln-Val-Pro-Phe-Ser-Arg-Xaa₁-Xaa₂-Phe-Ser-Xaa₄-[linker]-Thr-      (SEQ ID NO:1025)
      Val-Gly-Trp-Val-Gln-Arg-His-Arg-Lys-Met-Leu-Arg-(OH)NH₂ e56)  RNH-Lys-Ser-Xaa₃-Gln-Val-Pro-Phe-Ser-Arg-Xaa₁-Xaa₂-Phe-Ser-Xaa₄-[linker]-Thr-      (SEQ ID NO:1026)
      Val-Gly-Trp-Val-Gln-Arg-His-Arg-Lys-Met-Leu-Arg-(OH)NH₂ e57)  RNH-Lys-Ser-Met-Xaa₃-Val-Pro-Phe-Ser-Arg-Xaa₁-Xaa₂-Phe-Ser-Xaa₄-[linker]-Thr-      (SEQ ID NO:1027)
      Val-Gly-Trp-Val-Gln-Arg-His-Arg-Lys-Met-Leu-Arg-(OH)NH₂ e58)  RNH-Lys-Ser-Met-Gln-Xaa₃-Pro-Phe-Ser-Arg-Xaa₁-Xaa₂-Phe-Ser-Xaa₄-[linker]-Thr-      (SEQ ID NO:1028)
      Val-Gly-Trp-Val-Gln-Arg-His-Arg-Lys-Met-Leu-Arg-(OH)NH₂ e59)  RNH-Lys-Ser-Met-Gln-Val-Xaa₃-Phe-Ser-Arg-Xaa₁-Xaa₂-Phe-Ser-Xaa₄-[linker]-Thr-      (SEQ ID NO:1029)
      Val-Gly-Trp-Val-Gln-Arg-His-Arg-Lys-Met-Leu-Arg-(OH)NH₂ e60)  RNH-Lys-Ser-Met-Gln-Val-Pro-Xaa₃-Ser-Arg-Xaa₁-Xaa₂-Phe-Ser-Xaa₄-[linker]-Thr-      (SEQ ID NO:1030)
      Val-Gly-Trp-Val-Gln-Arg-His-Arg-Lys-Met-Leu-Arg-(OH)NH₂ e61)  RNH-Lys-Ser-Met-Gln-Val-Pro-Phe-Xaa₃-Arg-Xaa₁-Xaa₂-Phe-Ser-Xaa₄-[linker]-Thr-      (SEQ ID NO:1031)
      Val-Gly-Trp-Val-Gln-Arg-His-Arg-Lys-Met-Leu-Arg-(OH)NH₂ e62)  RNH-Lys-Ser-Met-Gln-Val-Pro-Phe-Ser-Xaa₃-Xaa₁-Xaa₂-Phe-Ser-Xaa₄-[linker]-Thr-      (SEQ ID NO:1032)
      Val-Gly-Trp-Val-Gln-Arg-His-Arg-Lys-Met-Leu-Arg-(OH)NH₂

I-309-(1—17)-[linker]-I-309-(52—64) acid or amide
e63)  RNH-Lys-Ser-Met-Gln-Val-Pro-Phe-Ser-Arg-Cys-Cys-Phe-Ser-Phe-Ala-Glu-Gln-          (SEQ ID NO:1033)
      [linker]-Thr-Val-Gly-Trp-Val-Gln-Arg-His-Arg-Lys-Met-Leu-Arg-(OH)NH₂ e64)  RNH-Lys-Ser-Met-Gln-Val-Pro-Phe-Ser-Arg-Xaa₁-Xaa₂-Phe-Ser-Phe-Ala-Glu-Gln-        (SEQ ID NO:1034)
      [linker]-Thr-Val-Gly-Trp-Val-Gln-Arg-His-Arg-Lys-Met-Leu-Arg-(OH)NH₂ e65)  RNH-Xaa₃-Ser-Met-Gln-Val-Pro-Phe-Ser-Arg-Xaa₁-Xaa₂-Phe-Ser-Phe-Ala-Glu-Gln-       (SEQ ID NO:1035)
      [linker]-Thr-Val-Gly-Trp-Val-Gln-Arg-His-Arg-Lys-Met-Leu-Arg-(OH)NH₂ e66)  RNH-Lys-Xaa₃-Met-Gln-Val-Pro-Phe-Ser-Arg-Xaa₁-Xaa₂-Phe-Ser-Phe-Ala-Glu-Gln-       (SEQ ID NO:1036)
      [linker]-Thr-Val-Gly-Trp-Val-Gln-Arg-His-Arg-Lys-Met-Leu-Arg-(OH)NH₂ e67)  RNH-Lys-Ser-Xaa₃-Gln-Val-Pro-Phe-Ser-Arg-Xaa₁-Xaa₂-Phe-Ser-Phe-Ala-Glu-Gln-       (SEQ ID NO:1037)
      [linker]-Thr-Val-Gly-Trp-Val-Gln-Arg-His-Arg-Lys-Met-Leu-Arg-(OH)NH₂ e68)  RNH-Lys-Ser-Met-Xaa₃-Val-Pro-Phe-Ser-Arg-Xaa₁-Xaa₂-Phe-Ser-Phe-Ala-Glu-Gln-       (SEQ ID NO:1038)
      [linker]-Thr-Val-Gly-Trp-Val-Gln-Arg-His-Arg-Lys-Met-Leu-Arg-(OH)NH₂ e69)  RNH-Lys-Ser-Met-Gln-Xaa₃-Pro-Phe-Ser-Arg-Xaa₁-Xaa₂-Phe-Ser-Phe-Ala-Glu-Gln-       (SEQ ID NO:1039)
      [linker]-Thr-Val-Gly-Trp-Val-Gln-Arg-His-Arg-Lys-Met-Leu-Arg-(OH)NH₂ e70)  RNH-Lys-Ser-Met-Gln-Val-Xaa₃-Phe-Ser-Arg-Xaa₁-Xaa₂-Phe-Ser-Phe-Ala-Glu-Gln-       (SEQ ID NO:1040)
      [linker]-Thr-Val-Gly-Trp-Val-Gln-Arg-His-Arg-Lys-Met-Leu-Arg-(OH)NH₂
```

```
                                              -continued
e71)  RNH-Lys-Ser-Met-Gln-Val-Pro-Xaa₁-Ser-Arg-Xaa₁-Xaa₂-Phe-Ser-Phe-Ala-Glu-Gln-            (SEQ ID NO:1041)
      [linker]-Thr-Val-Gly-Trp-Val-Gln-Arg-His-Arg-Lys-Met-Leu-Arg-(OH)NH₂ e72)  RNH-Lys-Ser-Met-Gln-Val-Pro-Phe-Xaa₃-Arg-Xaa₁-Xaa₂-Phe-Ser-Phe-Ala-Glu-Gln-            (SEQ ID NO:1042)
      [linker]-Thr-Val-Gly-Trp-Val-Gln-Arg-His-Arg-Lys-Met-Leu-Arg-(OH)NH₂ e73)  RNH-Lys-Ser-Met-Gln-Val-Pro-Phe-Ser-Xaa₃-Xaa₁-Xaa₂-Phe-Ser-Phe-Ala-Glu-Gln-            (SEQ ID NO:1043)
      [linker]-Thr-Val-Gly-Trp-Val-Gln-Arg-His-Arg-Lys-Met-Leu-Arg-(OH)NH₂ e74)  RNH-Lys-Ser-Met-Gln-Val-Pro-Phe-Ser-Arg-Cys-Cys-Xaa₄-Ser-Phe-Ala-Glu-Gln-              (SEQ ID NO:1044)
      [linker]-Thr-Val-Gly-Trp-Val-Gln-Arg-His-Arg-Lys-Met-Leu-Arg-(OH)NH₂ e75)  RNH-Lys-Ser-Met-Gln-Val-Pro-Phe-Ser-Arg-Xaa₁-Xaa₂-Xaa₄-Ser-Phe-Ala-Glu-Gln-            (SEQ ID NO:1045)
      [linker]-Thr-Val-Gly-Trp-Val-Gln-Arg-His-Arg-Lys-Met-Leu-Arg-(OH)NH₂ e76)  RNH-Xaa₃-Ser-Met-Gln-Val-Pro-Phe-Ser-Arg-Xaa₁-Xaa₂-Xaa₄-Ser-Phe-Ala-Glu-Gln-           (SEQ ID NO:1046)
      [linker]-Thr-Val-Gly-Trp-Val-Gln-Arg-His-Arg-Lys-Met-Leu-Arg-(OH)NH₂ e77)  RNH-Lys-Xaa₃-Met-Gln-Val-Pro-Phe-Ser-Arg-Xaa₁-Xaa₂-Xaa₄-Ser-Phe-Ala-Glu-Gln-           (SEQ ID NO:1047)
      [linker]-Thr-Val-Gly-Trp-Val-Gln-Arg-His-Arg-Lys-Met-Leu-Arg-(OH)NH₂ e78)  RNH-Lys-Ser-Xaa₃-Gln-Val-Pro-Phe-Ser-Arg-Xaa₁-Xaa₂-Xaa₄-Ser-Phe-Ala-Glu-Gln-           (SEQ ID NO:1048)
      [linker]-Thr-Val-Gly-Trp-Val-Gln-Arg-His-Arg-Lys-Met-Leu-Arg-(OH)NH₂ e79)  RNH-Lys-Ser-Met-Xaa₃-Val-Pro-Phe-Ser-Arg-Xaa₁-Xaa₂-Xaa₄-Ser-Phe-Ala-Glu-Gln-           (SEQ ID NO:1049)
      [linker]-Thr-Val-Gly-Trp-Val-Gln-Arg-His-Arg-Lys-Met-Leu-Arg-(OH)NH₂ e80)  RNH-Lys-Ser-Met-Gln-Xaa₃-Pro-Phe-Ser-Arg-Xaa₁-Xaa₂-Xaa₄-Ser-Phe-Ala-Glu-Gln-           (SEQ ID NO:1050)
      [linker]-Thr-Val-Gly-Trp-Val-Gln-Arg-His-Arg-Lys-Met-Leu-Arg-(OH)NH₂ e81)  RNH-Lys-Ser-Met-Gln-Val-Xaa₃-Phe-Ser-Arg-Xaa₁-Xaa₂-Xaa₄-Ser-Phe-Ala-Glu-Gln-           (SEQ ID NO:1051)
      [linker]-Thr-Val-Gly-Trp-Val-Gln-Arg-His-Arg-Lys-Met-Leu-Arg-(OH)NH₂ e82)  RNH-Lys-Ser-Met-Gln-Val-Pro-Xaa₃-Ser-Arg-Xaa₁-Xaa₂-Xaa₄-Ser-Phe-Ala-Glu-Gln-           (SEQ ID NO:1052)
      [linker]-Thr-Val-Gly-Trp-Val-Gln-Arg-His-Arg-Lys-Met-Leu-Arg-(OH)NH₂ e83)  RNH-Lys-Ser-Met-Gln-Val-Pro-Phe-Xaa₃-Arg-Xaa₁-Xaa₂-Xaa₄-Ser-Phe-Ala-Glu-Gln-           (SEQ ID NO:1053)
      [linker]-Thr-Val-Gly-Trp-Val-Gln-Arg-His-Arg-Lys-Met-Leu-Arg-(OH)NH₂ e84)  RNH-Lys-Ser-Met-Gln-Val-Pro-Phe-Ser-Xaa₃-Xaa₁-Xaa₂-Xaa₄-Ser-Phe-Ala-Glu-Gln-           (SEQ ID NO:1054)
      [linker]-Thr-Val-Gly-Trp-Val-Gln-Arg-His-Arg-Lys-Met-Leu-Arg-(OH)NH₂ e85)  RNH-Lys-Ser-Met-Gln-Val-Pro-Phe-Ser-Arg-Cys-Cys-Phe-Xaa₄-Phe-Ala-Glu-Gln-              (SEQ ID NO:1055)
      [linker]-Thr-Val-Gly-Trp-Val-Gln-Arg-His-Arg-Lys-Met-Leu-Arg-(OH)NH₂ e86)  RNH-Lys-Ser-Met-Gln-Val-Pro-Phe-Ser-Arg-Xaa₁-Xaa₂-Phe-Xaa₄-Phe-Ala-Glu-Gln-            (SEQ ID NO:1056)
      [linker]-Thr-Val-Gly-Trp-Val-Gln-Arg-His-Arg-Lys-Met-Leu-Arg-(OH)NH₂ e87)  RNH-Xaa₃-Ser-Met-Gln-Val-Pro-Phe-Ser-Arg-Xaa₁-Xaa₂-Phe-Xaa₄-Phe-Ala-Glu-Gln-           (SEQ ID NO:1057)
      [linker]-Thr-Val-Gly-Trp-Val-Gln-Arg-His-Arg-Lys-Met-Leu-Arg-(OH)NH₂ e88)  RNH-Lys-Xaa₃-Met-Gln-Val-Pro-Phe-Ser-Arg-Xaa₁-Xaa₂-Phe-Xaa₄-Phe-Ala-Glu-Gln-           (SEQ ID NO:1058)
      [linker]-Thr-Val-Gly-Trp-Val-Gln-Arg-His-Arg-Lys-Met-Leu-Arg-(OH)NH₂ e89)  RNH-Lys-Ser-Xaa₃-Gln-Val-Pro-Phe-Ser-Arg-Xaa₁-Xaa₂-Phe-Xaa₄-Phe-Ala-Glu-Gln-           (SEQ ID NO:1059)
      [linker]-Thr-Val-Gly-Trp-Val-Gln-Arg-His-Arg-Lys-Met-Leu-Arg-(OH)NH₂ e90)  RNH-Lys-Ser-Met-Xaa₃-Val-Pro-Phe-Ser-Arg-Xaa₁-Xaa₂-Phe-Xaa₄-Phe-Ala-Glu-Gln-           (SEQ ID NO:1060)
      [linker]-Thr-Val-Gly-Trp-Val-Gln-Arg-His-Arg-Lys-Met-Leu-Arg-(OH)NH₂ e91)  RNH-Lys-Ser-Met-Gln-Xaa₃-Pro-Phe-Ser-Arg-Xaa₁-Xaa₂-Phe-Xaa₄-Phe-Ala-Glu-Gln-           (SEQ ID NO:1061)
      [linker]-Thr-Val-Gly-Trp-Val-Gln-Arg-His-Arg-Lys-Met-Leu-Arg-(OH)NH₂ e92)  RNH-Lys-Ser-Met-Gln-Val-Xaa₃-Phe-Ser-Arg-Xaa₁-Xaa₂-Phe-Xaa₄-Phe-Ala-Glu-Gln-           (SEQ ID NO:1062)
      [linker]-Thr-Val-Gly-Trp-Val-Gln-Arg-His-Arg-Lys-Met-Leu-Arg-(OH)NH₂ e93)  RNH-Lys-Ser-Met-Gln-Val-Pro-Xaa₃-Ser-Arg-Xaa₁-Xaa₂-Phe-Xaa₄-Phe-Ala-Glu-Gln-           (SEQ ID NO:1063)
      [linker]-Thr-Val-Gly-Trp-Val-Gln-Arg-His-Arg-Lys-Met-Leu-Arg-(OH)NH₂ e94)  RNH-Lys-Ser-Met-Gln-Val-Pro-Phe-Xaa₃-Arg-Xaa₁-Xaa₂-Phe-Xaa₄-Phe-Ala-Glu-Gln-           (SEQ ID NO:1064)
      [linker]-Thr-Val-Gly-Trp-Val-Gln-Arg-His-Arg-Lys-Met-Leu-Arg-(OH)NH₂ e95)  RNH-Lys-Ser-Met-Gln-Val-Pro-Phe-Ser-Xaa₃-Xaa₁-Xaa₂-Phe-Xaa₄-Phe-Ala-Glu-Gln-           (SEQ ID NO:1065)
      [linker]-Thr-Val-Gly-Trp-Val-Gln-Arg-His-Arg-Lys-Met-Leu-Arg-(OH)NH₂ e96)  RNH-Lys-Ser-Met-Gln-Val-Pro-Phe-Ser-Arg-Cys-Cys-Phe-Ser-Xaa₄-Ala-Glu-Gln-              (SEQ ID NO:1066)
      [linker]-Thr-Val-Gly-Trp-Val-Gln-Arg-His-Arg-Lys-Met-Leu-Arg-(OH)NH₂ e97)  RNH-Lys-Ser-Met-Gln-Val-Pro-Phe-Ser-Arg-Xaa₁-Xaa₂-Phe-Ser-Xaa₄-Ala-Glu-Gln-            (SEQ ID NO:1067)
      [linker]-Thr-Val-Gly-Trp-Val-Gln-Arg-His-Arg-Lys-Met-Leu-Arg-(OH)NH₂
```

-continued e98) RNH-Xaa$_3$-Ser-Met-Gln-Val-Pro-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1068)

e99) RNH-Lys-Xaa$_3$-Met-Gln-Val-Pro-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1069)

e100) RNH-Lys-Ser-Xaa$_3$-Gln-Val-Pro-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1070)

e101) RNH-Lys-Ser-Met-Xaa$_3$-Val-Pro-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1071)

e102) RNH-Lys-Ser-Met-Gln-Xaa$_3$-Pro-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1072)

e103) RNH-Lys-Ser-Met-Gln-Val-Xaa$_3$-Phe-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1073)

e104) RNH-Lys-Ser-Met-Gln-Val-Pro-Xaa$_3$-Ser-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1074)

e105) RNH-Lys-Ser-Met-Gln-Val-Pro-Phe-Xaa$_3$-Arg-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1075)

e106) RNH-Lys-Ser-Met-Gln-Val-Pro-Phe-Ser-Xaa$_3$-Xaa$_1$-Xaa$_2$-Phe-Ser-Xaa$_4$-Ala-Glu-Gln-[linker]-Thr-Val-Gly-Trp-Val-Gln-Arg-His-Arg-Lys-Met-Leu-Arg-(OH)NH$_2$  (SEQ ID NO:1076)

e107) RNH-Lys-Ser-Met-Gln-Val-Pro-Phe-Ser-Arg-Cys-Cys-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1077)

e108) RNH-Lys-Ser-Met-Gln-Val-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1078)

e109) RNH-Xaa$_3$-Ser-Met-Gln-Val-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1079)

e110) RNH-Lys-Xaa$_3$-Met-Gln-Val-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1080)

e111) RNH-Lys-Ser-Xaa$_3$-Gln-Val-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1081)

e112) RNH-Lys-Ser-Met-Xaa$_3$-Val-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1082)

e113) RNH-Lys-Ser-Met-Gln-Xaa$_3$-Pro-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1083)

e114) RNH-Lys-Ser-Met-Gln-Val-Xaa$_3$-Phe-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1084)

e115) RNH-Lys-Ser-Met-Gln-Val-Pro-Xaa$_3$-Ser-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Asg-(OH)NH$_2$  (SEQ ID NO:1085)

e116) RNH-Lys-Ser-Met-Gln-Val-Pro-Phe-Xaa$_3$-Arg-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1086)

e117) RNH-Lys-Ser-Met-Gln-Val-Pro-Phe-Ser-Xaa$_3$-Xaa$_1$-Xaa$_2$-Phe-Ser-Phe-Xaa$_4$-Glu-Gln-[linker]-Thr-Val-Gly-Trp-Val-Gln-Arg-His-Arg-Lys-Met-Leu-Arg-(OH)NH$_2$  (SEQ ID NO:1087)

e118) RNH-Lys-Ser-Met-Gln-Val-Pro-Phe-Ser-Arg-Cys-Cys-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1088)

e119) RNH-Lys-Ser-Met-Gln-Val-Pro-Phe-Ser-Arg-Xaa$_1$-Xaa$_2$-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1089)

e120) RNH-Xaa$_3$-Ser-Met-Gln-Val-Pro-Phe-Ser-Arg-Xaa$_1$-Xaa$_2$-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1090)

e121) RNH-Lys-Xaa$_3$-Met-Gln-Val-Pro-Phe-Ser-Arg-Xaa$_1$-Xaa$_2$-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1091)

e122) RNH-Lys-Ser-Xaa$_3$-Gln-Val-Pro-Phe-Ser-Arg-Xaa$_1$-Xaa$_2$-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1092)

e123) RNH-Lys-Ser-Met-Xaa$_3$-Val-Pro-Phe-Ser-Arg-Xaa$_1$-Xaa$_2$-Phe-Ser-Phe-Ala-Xaa$_4$-Gln-[linker]-Thr-Val-Gly-Trp-Val-Gln-Arg-His-Arg-Lys-Met-Leu-Arg-(OH)NH$_2$  (SEQ ID NO:1093)

e124) RNH-Lys-Ser-Met-Gln-Val-Pro-Phe-Ser-Arg-Cys-Cys-Phe-Ser-Phe-Ala-Glu-Xaa$_4$-     (SEQ ID NO:1094)
      [linker]-Thr-Val-Gly-Trp-Val-Gln-Arg-His-Arg-Lys-Met-Leu-Arg-(OH)NH$_2$ e125) RNH-Lys-Ser-Met-Gln-Val-Pro-Phe-Ser-Arg-Xaa$_1$-Xaa$_2$-Phe-Ser-Phe-Ala-Glu-Xaa$_4$-     (SEQ ID NO:1095)
      [linker]-Thr-Val-Gly-Trp-Val-Gln-Arg-His-Arg-Lys-Met-Leu-Arg-(OH)NH$_2$ e126) RNH-Xaa$_3$-Ser-Met-Gln-Val-Pro-Phe-Ser-Arg-Xaa$_1$-Xaa$_2$-Phe-Ser-Phe-Ala-Glu-Xaa$_4$-     (SEQ ID NO:1096)
      [linker]-Thr-Val-Gly-Trp-Val-Gln-Arg-His-Arg-Lys-Met-Leu-Arg-(OH)NH$_2$ e127) RNH-Lys-Xaa$_3$-Met-Gln-Val-Pro-Phe-Ser-Arg-Xaa$_1$-Xaa$_2$-Phe-Ser-Phe-Ala-Glu-Xaa$_4$-     (SEQ ID NO:1097)
      [linker]-Thr-Val-Gly-Trp-Val-Gln-Arg-His-Arg-Lys-Met-Leu-Arg-(OH)NH$_2$ e128) RNH-Lys-Ser-Xaa$_3$-Gln-Val-Pro-Phe-Ser-Arg-Xaa$_1$-Xaa$_2$-Phe-Ser-Phe-Ala-Glu-Xaa$_4$-     (SEQ ID NO:1098)
      [linker]-Thr-Val-Gly-Trp-Val-Gln-Arg-His-Arg-Lys-Met-Leu-Arg-(OH)NH$_2$ e129) RNH-Lys-Ser-Met-Xaa$_3$-Val-Pro-Phe-Ser-Arg-Xaa$_1$-Xaa$_2$-Phe-Ser-Phe-Ala-Glu-Xaa$_4$-     (SEQ ID NO:1099)
      [linker]-Thr-Val-Gly-Trp-Val-Gln-Arg-His-Arg-Lys-Met-Leu-Arg-(OH)NH$_2$ e130) RNH-Lys-Ser-Met-Gln-Xaa$_3$-Pro-Phe-Ser-Arg-Xaa$_1$-Xaa$_2$-Phe-Ser-Phe-Ala-Glu-Xaa$_4$-     (SEQ ID NO:1100)
      [linker]-Thr-Val-Gly-Trp-Val-Gln-Arg-His-Arg-Lys-Met-Leu-Arg-(OH)NH$_2$ e131) RNH-Lys-Ser-Met-Gln-Val-Xaa$_3$-Phe-Ser-Arg-Xaa$_1$-Xaa$_2$-Phe-Ser-Phe-Ala-Glu-Xaa$_4$-     (SEQ ID NO:1101)
      [linker]-Thr-Val-Gly-Trp-Val-Gln-Arg-His-Arg-Lys-Met-Leu-Arg-(OH)NH$_2$ e132) RNH-Lys-Ser-Met-Gln-Val-Pro-Xaa$_3$-Ser-Arg-Xaa$_1$-Xaa$_2$-Phe-Ser-Phe-Ala-Glu-Xaa$_4$-     (SEQ ID NO:1102)
      [linker]-Thr-Val-Gly-Trp-Val-Gln-Arg-His-Arg-Lys-Met-Leu-Arg-(OH)NH$_2$ e133) RNH-Lys-Ser-Met-Gln-Val-Pro-Phe-Xaa$_3$-Arg-Xaa$_1$-Xaa$_2$-Phe-Ser-Phe-Ala-Glu-Xaa$_4$-     (SEQ ID NO:1103)
      [linker]-Thr-Val-Gly-Trp-Val-Gln-Arg-His-Arg-Lys-Met-Leu-Arg-(OH)NH$_2$ e134) RNH-Lys-Ser-Met-Gln-Val-Pro-Phe-Ser-Xaa$_3$-Xaa$_1$-Xaa$_2$-Phe-Ser-Phe-Ala-Glu-Xaa$_4$-     (SEQ ID NO:1104)
      [linker]-Thr-Val-Gly-Trp-Val-Gln-Arg-His-Arg-Lys-Met-Leu-Arg-(OH)NH$_2$

[Glu$^{57}$]-I-309-(1–14)-[linker]-[Glu$^{57}$]-I-309-(52–62) acid or amide
e135) RNH-Lys-Ser-Met-Gln-Val-Pro-Phe-Ser-Arg-Cys-Cys-Phe-Ser-Phe-[linker]-Thr-Val-     (SEQ ID NO:1105)
      Gly-Trp-Val-Glu-Arg-His-Arg-Lys-Met-Leu-Arg-(OH)NH$_2$ e136) RNH-Lys-Ser-Met-Gln-Val-Pro-Phe-Ser-Arg-Xaa$_1$-Xaa$_2$-Phe-Ser-Phe-[linker]-Thr-     (SEQ ID NO:1106)
      Val-Gly-Trp-Val-Glu-Arg-His-Arg-Lys-Met-Leu-Arg-(OH)NH$_2$ e137) RNH-Xaa$_3$-Ser-Met-Gln-Val-Pro-Phe-Ser-Arg-Xaa$_1$-Xaa$_2$-Phe-Ser-Phe-[linker]-Thr-     (SEQ ID NO:1107)
      Val-Gly-Trp-Val-Glu-Arg-His-Arg-Lys-Met-Leu-Arg-(OH)NH$_2$ e138) RNH-Lys-Xaa$_3$-Met-Gln-Val-Pro-Phe-Ser-Arg-Xaa$_1$-Xaa$_2$-Phe-Ser-Phe-[linker]-Thr-     (SEQ ID NO:1108)
      Val-Gly-Trp-Val-Glu-Arg-His-Arg-Lys-Met-Leu-Arg-(OH)NH$_2$ e139) RNH-Lys-Ser-Xaa$_3$-Gln-Val-Pro-Phe-Ser-Arg-Xaa$_1$-Xaa$_2$-Phe-Ser-Phe-[linker]-Thr-     (SEQ ID NO:1109)
      Val-Gly-Trp-Val-Glu-Arg-His-Arg-Lys-Met-Leu-Arg-(OH)NH$_2$ e140) RNH-Lys-Ser-Met-Xaa$_3$-Val-Pro-Phe-Ser-Arg-Xaa$_1$-Xaa$_2$-Phe-Ser-Phe-[linker]-Thr-     (SEQ ID NO:1110)
      Val-Gly-Trp-Val-Glu-Arg-His-Arg-Lys-Met-Leu-Arg-(OH)NH$_2$ e141) RNH-Lys-Ser-Met-Gln-Xaa$_3$-Pro-Phe-Ser-Arg-Xaa$_1$-Xaa$_2$-Phe-Ser-Phe-[linker]-Thr-     (SEQ ID NO:1111)
      Val-Gly-Trp-Val-Glu-Arg-His-Arg-Lys-Met-Leu-Arg-(OH)NH$_2$ e142) RNH-Lys-Ser-Met-Gln-Val-Xaa$_3$-Phe-Ser-Arg-Xaa$_1$-Xaa$_2$-Phe-Ser-Phe-[linker]-Thr-     (SEQ ID NO:1112)
      Val-Gly-Trp-Val-Glu-Arg-His-Arg-Lys-Met-Leu-Arg-(OH)NH$_2$ e143) RNH-Lys-Ser-Met-Gln-Val-Pro-Xaa$_3$-Ser-Arg-Xaa$_1$-Xaa$_2$-Phe-Ser-Phe-[linker]-Thr-     (SEQ ID NO:1113)
      Val-Gly-Trp-Val-Glu-Arg-His-Arg-Lys-Met-Leu-Arg-(OH)NH$_2$ e144) RNH-Lys-Ser-Met-Gln-Val-Pro-Phe-Xaa$_3$-Arg-Xaa$_1$-Xaa$_2$-Phe-Ser-Phe-[linker]-Thr-     (SEQ ID NO:1114)
      Val-Gly-Trp-Val-Glu-Arg-His-Arg-Lys-Met-Leu-Arg-(OH)NH$_2$ e145) RNH-Lys-Ser-Met-Gln-Val-Pro-Phe-Ser-Xaa$_3$-Xaa$_1$-Xaa$_2$-Phe-Ser-Phe-[linker]-Thr-     (SEQ ID NO:1115)
      Val-Gly-Trp-Val-Glu-Arg-His-Arg-Lys-Met-Leu-Arg-(OH)NH$_2$ e146) RNH-Lys-Ser-Met-Gln-Val-Pro-Phe-Ser-Arg-Cys-Cys-Xaa$_4$-Ser-Phe-[linker]-Thr-     (SEQ ID NO:1116)
      Val-Gly-Trp-Val-Glu-Arg-His-Arg-Lys-Met-Leu-Arg-(OH)NH$_2$ e147) RNH-Lys-Ser-Met-Gln-Val-Pro-Phe-Ser-Arg-Xaa$_1$-Xaa$_2$-Xaa$_4$-Ser-Phe-[linker]-Thr-     (SEQ ID NO:1117)
      Val-Gly-Trp-Val-Glu-Arg-His-Arg-Lys-Met-Leu-Arg-(OH)NH$_2$ e148) RNH-Xaa$_3$-Ser-Met-Gln-Val-Pro-Phe-Ser-Arg-Xaa$_1$-Xaa$_2$-Xaa$_4$-Ser-Phe-[linker]-Thr-     (SEQ ID NO:1118)
      Val-Gly-Trp-Val-Glu-Arg-His-Arg-Lys-Met-Leu-Arg-(OH)NH$_2$ e149) RNH-Lys-Xaa$_3$-Met-Gln-Val-Pro-Phe-Ser-Arg-Xaa$_1$-Xaa$_2$-Xaa$_4$-Ser-Phe-[linker]-Thr-     (SEQ ID NO:1119)
      Val-Gly-Trp-Val-Glu-Arg-His-Arg-Lys-Met-Leu-Arg-(OH)NH$_2$ -continued e150) RNH-Lys-Ser-Xaa$_3$-Gln-Val-Pro-Phe-Ser-Arg-Xaa$_1$-Xaa$_2$-Xaa$_4$-Ser-Phe-[linker]-Thr-      (SEQ ID NO:1120)
     Val-Gly-Trp-Val-Glu-Arg-His-Arg-Lys-Met-Leu-Arg-(OH)NH$_2$ e151) RNH-Lys-Ser-Met-Xaa$_3$-Val-Pro-Phe-Ser-Arg-Xaa$_1$-Xaa$_2$-Xaa$_4$-Ser-Phe-[linker]-Thr-      (SEQ ID NO:1121)
     Val-Gly-Trp-Val-Glu-Arg-His-Arg-Lys-Met-Leu-Arg-(OH)NH$_2$ e152) RNH-Lys-Ser-Met-Gln-Xaa$_3$-Pro-Phe-Ser-Arg-Xaa$_1$-Xaa$_2$-Xaa$_4$-Ser-Phe-[linker]-Thr-      (SEQ ID NO:1122)
     Val-Gly-Trp-Val-Glu-Arg-His-Arg-Lys-Met-Leu-Arg-(OH)NH$_2$ e153) RNH-Lys-Ser-Met-Gln-Val-Xaa$_3$-Phe-Ser-Arg-Xaa$_1$-Xaa$_2$-Xaa$_4$-Ser-Phe-[linker]-Thr-      (SEQ ID NO:1123)
     Val-Gly-Trp-Val-Glu-Arg-His-Arg-Lys-Met-Leu-Arg-(OH)NH$_2$ e154) RNH-Lys-Ser-Met-Gln-Val-Pro-Xaa$_3$-Ser-Arg-Xaa$_1$-Xaa$_2$-Xaa$_4$-Ser-Phe-[linker]-Thr-      (SEQ ID NO:1124)
     Val-Gly-Trp-Val-Glu-Arg-His-Arg-Lys-Met-Leu-Arg-(OH)NH$_2$ e155) RNH-Lys-Ser-Met-Gln-Val-Pro-Phe-Xaa$_3$-Arg-Xaa$_1$-Xaa$_2$-Xaa$_4$-Ser-Phe-[linker]-Thr-      (SEQ ID NO:1125)
     Val-Gly-Trp-Val-Glu-Arg-His-Arg-Lys-Met-Leu-Arg-(OH)NH$_2$ e156) RNH-Lys-Ser-Met-Gln-Val-Pro-Phe-Ser-Xaa$_3$-Xaa$_1$-Xaa$_2$-Xaa$_4$-Ser-Phe-[linker]-Thr-      (SEQ ID NO:1126)
     Val-Gly-Trp-Val-Glu-Arg-His-Arg-Lys-Met-Leu-Arg-(OH)NH$_2$ e157) RNH-Lys-Ser-Met-Gln-Val-Pro-Phe-Ser-Arg-Cys-Cys-Phe-Xaa$_4$-Phe-[linker]-Thr-                  (SEQ ID NO:1127)
     Val-Gly-Trp-Val-Glu-Arg-His-Arg-Lys-Met-Leu-Arg-(OH)NH$_2$ e158) RNH-Lys-Ser-Met-Gln-Val-Pro-Phe-Ser-Arg-Xaa$_1$-Xaa$_2$-Phe-Xaa$_4$-Phe-[linker]-Thr-          (SEQ ID NO:1128)
     Val-Gly-Trp-Val-Glu-Arg-His-Arg-Lys-Met-Leu-Arg-(OH)NH$_2$ e159) RNH-Xaa$_3$-Ser-Met-Gln-Val-Pro-Phe-Ser-Arg-Xaa$_1$-Xaa$_2$-Phe-Xaa$_4$-Phe-[linker]-Thr-      (SEQ ID NO:1129)
     Val-Gly-Trp-Val-Glu-Arg-His-Arg-Lys-Met-Leu-Arg-(OH)NH$_2$ e160) RNH-Lys-Xaa$_3$-Met-Gln-Val-Pro-Phe-Ser-Arg-Xaa$_1$-Xaa$_2$-Phe-Xaa$_4$-Phe-[linker]-Thr-      (SEQ ID NO:1130)
     Val-Gly-Trp-Val-Glu-Arg-His-Arg-Lys-Met-Leu-Arg-(OH)NH$_2$ e161) RNH-Lys-Ser-Xaa$_3$-Gln-Val-Pro-Phe-Ser-Arg-Xaa$_1$-Xaa$_2$-Phe-Xaa$_4$-Phe-[linker]-Thr-      (SEQ ID NO:1131)
     Val-Gly-Trp-Val-Glu-Arg-His-Arg-Lys-Met-Leu-Arg-(OH)NH$_2$ e162) RNH-Lys-Ser-Met-Xaa$_3$-Val-Pro-Phe-Ser-Arg-Xaa$_1$-Xaa$_2$-Phe-Xaa$_4$-Phe-[linker]-Thr-      (SEQ ID NO:1132)
     Val-Gly-Trp-Val-Glu-Arg-His-Arg-Lys-Met-Leu-Arg-(OH)NH$_2$ e163) RNH-Lys-Ser-Met-Gln-Xaa$_3$-Pro-Phe-Ser-Arg-Xaa$_1$-Xaa$_2$-Phe-Xaa$_4$-Phe-[linker]-Thr-      (SEQ ID NO:1133)
     Val-Gly-Trp-Val-Glu-Arg-His-Arg-Lys-Met-Leu-Arg-(OH)NH$_2$ e164) RNH-Lys-Ser-Met-Gln-Val-Xaa$_3$-Phe-Ser-Arg-Xaa$_1$-Xaa$_2$-Phe-Xaa$_4$-Phe-[linker]-Thr-      (SEQ ID NO:1134)
     Val-Gly-Trp-Val-Glu-Arg-His-Arg-Lys-Met-Leu-Arg-(OH)NH$_2$ e165) RNH-Lys-Ser-Met-Gln-Val-Pro-Xaa$_3$-Ser-Arg-Xaa$_1$-Xaa$_2$-Phe-Xaa$_4$-Phe-[linker]-Thr-      (SEQ ID NO:1135)
     Val-Gly-Trp-Val-Glu-Arg-His-Arg-Lys-Met-Leu-Arg-(OH)NH$_2$ e166) RNH-Lys-Ser-Met-Gln-Val-Pro-Phe-Xaa$_3$-Arg-Xaa$_1$-Xaa$_2$-Phe-Xaa$_4$-Phe-[linker]-Thr-      (SEQ ID NO:1136)
     Val-Gly-Trp-Val-Glu-Arg-His-Arg-Lys-Met-Leu-Arg-(OH)NH$_2$ e167) RNH-Lys-Ser-Met-Gln-Val-Pro-Phe-Ser-Xaa$_3$-Xaa$_1$-Xaa$_2$-Phe-Xaa$_4$-Phe-[linker]-Thr-      (SEQ ID NO:1137)
     Val-Gly-Trp-Val-Glu-Arg-His-Arg-Lys-Met-Leu-Arg-(OH)NH$_2$ e168) RNH-Lys-Ser-Met-Gln-Val-Pro-Phe-Ser-Arg-Cys-Cys-Phe-Ser-Xaa$_4$-[linker]-Thr-                  (SEQ ID NO:1138)
     Val-Gly-Trp-Val-Glu-Arg-His-Arg-Lys-Met-Leu-Arg-(OH)NH$_2$ e169) RNH-Lys-Ser-Met-Gln-Val-Pro-Phe-Ser-Arg-Xaa$_1$-Xaa$_2$-Phe-Ser-Xaa$_4$-[linker]-Thr-          (SEQ ID NO:1139)
     Val-Gly-Trp-Val-Glu-Arg-His-Arg-Lys-Met-Leu-Arg-(OH)NH$_2$ e170) RNH-Xaa$_3$-Ser-Met-Gln-Val-Pro-Phe-Ser-Arg-Xaa$_1$-Xaa$_2$-Phe-Ser-Xaa$_4$-[linker]-Thr-      (SEQ ID NO:1140)
     Val-Gly-Trp-Val-Glu-Arg-His-Arg-Lys-Met-Leu-Arg-(OH)NH$_2$ e171) RNH-Lys-Xaa$_3$-Met-Gln-Val-Pro-Phe-Ser-Arg-Xaa$_1$-Xaa$_2$-Phe-Ser-Xaa$_4$-[linker]-Thr-      (SEQ ID NO:1141)
     Val-Gly-Trp-Val-Glu-Arg-His-Arg-Lys-Met-Leu-Arg-(OH)NH$_2$ e172) RNH-Lys-Ser-Xaa$_3$-Gln-Val-Pro-Phe-Ser-Arg-Xaa$_1$-Xaa$_2$-Phe-Ser-Xaa$_4$-[linker]-Thr-      (SEQ ID NO:1142)
     Val-Gly-Trp-Val-Glu-Arg-His-Arg-Lys-Met-Leu-Arg-(OH)NH$_2$ e173) RNH-Lys-Ser-Met-Xaa$_3$-Val-Pro-Phe-Ser-Arg-Xaa$_1$-Xaa$_2$-Phe-Ser-Xaa$_4$-[linker]-Thr-      (SEQ ID NO:1143)
     Val-Gly-Trp-Val-Glu-Arg-His-Arg-Lys-Met-Leu-Arg-(OH)NH$_2$ e174) RNH-Lys-Ser-Met-Gln-Xaa$_3$-Pro-Phe-Ser-Arg-Xaa$_1$-Xaa$_2$-Phe-Ser-Xaa$_4$-[linker]-Thr-      (SEQ ID NO:1144)
     Val-Gly-Trp-Val-Glu-Arg-His-Arg-Lys-Met-Leu-Arg-(OH)NH$_2$ e175) RNH-Lys-Ser-Met-Gln-Val-Xaa$_3$-Phe-Ser-Arg-Xaa$_1$-Xaa$_2$-Phe-Ser-Xaa$_4$-[linker]-Thr-      (SEQ ID NO:1145)
     Val-Gly-Trp-Val-Glu-Arg-His-Arg-Lys-Met-Leu-Arg-(OH)NH$_2$ e176) RNH-Lys-Ser-Met-Gln-Val-Pro-Xaa$_3$-Ser-Arg-Xaa$_1$-Xaa$_2$-Phe-Ser-Xaa$_4$-[linker]-Thr-      (SEQ ID NO:1146)
     Val-Gly-Trp-Val-Glu-Arg-His-Arg-Lys-Met-Leu-Arg-(OH)NH$_2$ -continued e177) RNH-Lys-Ser-Met-Gln-Val-Pro-Phe-Xaa$_3$-Arg-Xaa$_1$-Xaa$_2$-Phe-Ser-Xaa$_4$-[linker]-Thr- (SEQ ID NO:1147)
Val-Gly-Trp-Val-Glu-Arg-His-Arg-Lys-Met-Leu-Arg-(OH)NH$_2$ e178) RNH-Lys-Ser-Met-Gln-Val-Pro-Phe-Ser-Xaa$_3$-Xaa$_1$-Xaa$_2$-Phe-Ser-Xaa$_4$-[linker]-Thr- (SEQ ID NO:1148)
Val-Gly-Trp-Val-Glu-Arg-His-Arg-Lys-Met-Leu-Arg-(OH)NH$_2$

[Glu$^{57}$]-I-309-(1–17)-[linker]-[Glu$^{57}$]-I-309-(52–62) acid or amide e179) RNH-Lys-Ser-Met-Gln-Val-Pro-Phe-Ser-Arg-Cys-Cys-Phe-Ser-Phe-Ala-Glu-Gln- (SEQ ID NO:1149)
[linker]-Thr-Val-Gly-Trp-Val-Glu-Arg-His-Arg-Lys-Met-Leu-Arg-(OH)NH$_2$ e180) RNH-Lys-Ser-Met-Gln-Val-Pro-Phe-Ser-Arg-Xaa$_1$-Xaa$_2$-Phe-Ser-Phe-Ala-Glu-Gln- (SEQ ID NO:1150)
[linker]-Thr-Val-Gly-Trp-Val-Glu-Arg-His-Arg-Lys-Met-Leu-Arg-(OH)NH$_2$ e181) RNH-Xaa$_3$-Ser-Met-Gln-Val-Pro-Phe-Ser-Arg-Xaa$_1$-Xaa$_2$-Phe-Ser-Phe-Ala-Glu-Gln- (SEQ ID NO:1151)
[linker]-Thr-Val-Gly-Trp-Val-Glu-Arg-His-Arg-Lys-Met-Leu-Arg-(OH)NH$_2$ e182) RNH-Lys-Xaa$_3$-Met-Gln-Val-Pro-Phe-Ser-Arg-Xaa$_1$-Xaa$_2$-Phe-Ser-Phe-Ala-Glu-Gln- (SEQ ID NO:1152)
[linker]-Thr-Val-Gly-Trp-Val-Glu-Arg-His-Arg-Lys-Met-Leu-Arg-(OH)NH$_2$ e183) RNH-Lys-Ser-Xaa$_3$-Gln-Val-Pro-Phe-Ser-Arg-Xaa$_1$-Xaa$_2$-Phe-Ser-Phe-Ala-Glu-Gln- (SEQ ID NO:1153)
[linker]-Thr-Val-Gly-Trp-Val-Glu-Arg-His-Arg-Lys-Met-Leu-Arg-(OH)NH$_2$ e184) RNH-Lys-Ser-Met-Xaa$_3$-Val-Pro-Phe-Ser-Arg-Xaa$_1$-Xaa$_2$-Phe-Ser-Phe-Ala-Glu-Gln- (SEQ ID NO:1154)
[linker]-Thr-Val-Gly-Trp-Val-Glu-Arg-His-Arg-Lys-Met-Leu-Arg-(OH)NH$_2$ e185) RNH-Lys-Ser-Met-Gln-Xaa$_3$-Pro-Phe-Ser-Arg-Xaa$_1$-Xaa$_2$-Phe-Ser-Phe-Ala-Glu-Gln- (SEQ ID NO:1155)
[linker]-Thr-Val-Gly-Trp-Val-Glu-Arg-His-Arg-Lys-Met-Leu-Arg-(OH)NH$_2$ e186) RNH-Lys-Ser-Met-Gln-Val-Xaa$_3$-Phe-Ser-Arg-Xaa$_1$-Xaa$_2$-Phe-Ser-Phe-Ala-Glu-Gln- (SEQ ID NO:1156)
[linker]-Thr-Val-Gly-Trp-Val-Glu-Arg-His-Arg-Lys-Met-Leu-Arg-(OH)NH$_2$ e187) RNH-Lys-Ser-Met-Gln-Val-Pro-Xaa$_3$-Ser-Arg-Xaa$_1$-Xaa$_2$-Phe-Ser-Phe-Ala-Glu-Gln- (SEQ ID NO:1157)
[linker]-Thr-Val-Gly-Trp-Val-Glu-Arg-His-Arg-Lys-Met-Leu-Arg-(OH)NH$_2$ e188) RNH-Lys-Ser-Met-Gln-Val-Pro-Phe-Xaa$_3$-Arg-Xaa$_1$-Xaa$_2$-Phe-Ser-Phe-Ala-Glu-Gln- (SEQ ID NO:1158)
[linker]-Thr-Val-Gly-Trp-Val-Glu-Arg-His-Arg-Lys-Met-Leu-Arg-(OH)NH$_2$ e189) RNH-Lys-Ser-Met-Gln-Val-Pro-Phe-Ser-Xaa$_3$-Xaa$_1$-Xaa$_2$-Phe-Ser-Phe-Ala-Glu-Gln- (SEQ ID NO:1159)
[linker]-Thr-Val-Gly-Trp-Val-Glu-Arg-His-Arg-Lys-Met-Leu-Arg-(OH)NH$_2$ e190) RNH-Lys-Ser-Met-Gln-Val-Pro-Phe-Ser-Arg-Cys-Cys-Xaa$_4$-Ser-Phe-Ala-Glu-Gln- (SEQ ID NO:1160)
[linker]-Thr-Val-Gly-Trp-Val-Glu-Arg-His-Arg-Lys-Met-Leu-Arg-(OH)NH$_2$ e191) RNH-Lys-Ser-Met-Gln-Val-Pro-Phe-Ser-Arg-Xaa$_1$-Xaa$_2$-Xaa$_4$-Ser-Phe-Ala-Glu-Gln- (SEQ ID NO:1161)
[linker]-Thr-Val-Gly-Trp-Val-Glu-Arg-His-Arg-Lys-Met-Leu-Arg-(OH)NH$_2$ e192) RNH-Xaa$_3$-Ser-Met-Gln-Val-Pro-Phe-Ser-Arg-Xaa$_1$-Xaa$_2$-Xaa$_4$-Ser-Phe-Ala-Glu-Gln- (SEQ ID NO:1162)
[linker]-Thr-Val-Gly-Trp-Val-Glu-Arg-His-Arg-Lys-Met-Leu-Arg-(OH)NH$_2$ e193) RNH-Lys-Xaa$_3$-Met-Gln-Val-Pro-Phe-Ser-Arg-Xaa$_1$-Xaa$_2$-Xaa$_4$-Ser-Phe-Ala-Glu-Gln- (SEQ ID NO:1163)
[linker]-Thr-Val-Gly-Trp-Val-Glu-Arg-His-Arg-Lys-Met-Leu-Arg-(OH)NH$_2$ e194) RNH-Lys-Ser-Xaa$_3$-Gln-Val-Pro-Phe-Ser-Arg-Xaa$_1$-Xaa$_2$-Xaa$_4$-Ser-Phe-Ala-Glu-Gln- (SEQ ID NO:1164)
[linker]-Thr-Val-Gly-Trp-Val-Glu-Arg-His-Arg-Lys-Met-Leu-Arg-(OH)NH$_2$ e195) RNH-Lys-Ser-Met-Xaa$_3$-Val-Pro-Phe-Ser-Arg-Xaa$_1$-Xaa$_2$-Xaa$_4$-Ser-Phe-Ala-Glu-Gln- (SEQ ID NO:1165)
[linker]-Thr-Val-Gly-Trp-Val-Glu-Arg-His-Arg-Lys-Met-Leu-Arg-(OH)NH$_2$ e196) RNH-Lys-Ser-Met-Gln-Xaa$_3$-Pro-Phe-Ser-Arg-Xaa$_1$-Xaa$_2$-Xaa$_4$-Ser-Phe-Ala-Glu-Gln- (SEQ ID NO:1166)
[linker]-Thr-Val-Gly-Trp-Val-Glu-Arg-His-Arg-Lys-Met-Leu-Arg-(OH)NH$_2$ e197) RNH-Lys-Ser-Met-Gln-Val-Xaa$_3$-Phe-Ser-Arg-Xaa$_1$-Xaa$_2$-Xaa$_4$-Ser-Phe-Ala-Glu-Gln- (SEQ ID NO:1167)
[linker]-Thr-Val-Gly-Trp-Val-Glu-Arg-His-Arg-Lys-Met-Leu-Arg-(OH)NH$_2$ e198) RNH-Lys-Ser-Met-Gln-Val-Pro-Xaa$_3$-Ser-Arg-Xaa$_1$-Xaa$_2$-Xaa$_4$-Ser-Phe-Ala-Glu-Gln- (SEQ ID NO:1168)
[linker]-Thr-Val-Gly-Trp-Val-Glu-Arg-His-Arg-Lys-Met-Leu-Arg-(OH)NH$_2$ e199) RNH-Lys-Ser-Met-Gln-Val-Pro-Phe-Xaa$_3$-Arg-Xaa$_1$-Xaa$_2$-Xaa$_4$-Ser-Phe-Ala-Glu-Gln- (SEQ ID NO:1169)
[linker]-Thr-Val-Gly-Trp-Val-Glu-Arg-His-Arg-Lys-Met-Leu-Arg-(OH)NH$_2$ e200) RNH-Lys-Ser-Met-Gln-Val-Pro-Phe-Ser-Xaa$_3$-Xaa$_1$-Xaa$_2$-Xaa$_4$-Ser-Phe-Ala-Glu-Gln- (SEQ ID NO:1170)
[linker]-Thr-Val-Gly-Trp-Val-Glu-Arg-His-Arg-Lys-Met-Leu-Arg-(OH)NH$_2$ e201) RNH-Lys-Ser-Met-Gln-Val-Pro-Phe-Ser-Arg-Cys-Cys-Phe-Xaa$_4$-Phe-Ala-Glu-Gln- (SEQ ID NO:1171)
[linker]-Thr-Val-Gly-Trp-Val-Glu-Arg-His-Arg-Lys-Met-Leu-Arg-(OH)NH$_2$ e202) RNH-Lys-Ser-Met-Gln-Val-Pro-Phe-Ser-Arg-Xaa$_1$-Xaa$_2$-Phe-Xaa$_4$-Phe-Ala-Glu-Gln- (SEQ ID NO:1172)
[linker]-Thr-Val-Gly-Trp-Val-Glu-Arg-His-Arg-Lys-Met-Leu-Arg-(OH)NH$_2$ e203) RNH-Xaa$_3$-Ser-Met-Gln-Val-Pro-Phe-Ser-Arg-Xaa$_1$-Xaa$_2$-Phe-Xaa$_4$-Phe-Ala-Glu-Gln- (SEQ ID NO:1173)
[linker]-Thr-Val-Gly-Trp-Val-Glu-Arg-His-Arg-Lys-Met-Leu-Arg-(OH)NH$_2$ e204) RNH-Lys-Xaa$_3$-Met-Gln-Val-Pro-Phe-Ser-Arg-Xaa$_1$-Xaa$_2$-Phe-Xaa$_4$-Phe-Ala-Glu-Gln- (SEQ ID NO:1174)
[linker]-Thr-Val-Gly-Trp-Val-Glu-Arg-His-Arg-Lys-Met-Leu-Arg-(OH)NH$_2$ e205) RNH-Lys-Ser-Xaa$_3$-Gln-Val-Pro-Phe-Ser-Arg-Xaa$_1$-Xaa$_2$-Phe-Xaa$_4$-Phe-Ala-Glu-Gln- (SEQ ID NO:1175)
[linker]-Thr-Val-Gly-Trp-Val-Glu-Arg-His-Arg-Lys-Met-Leu-Arg-(OH)NH$_2$ e206) RNH-Lys-Ser-Met-Xaa$_3$-Val-Pro-Phe-Ser-Arg-Xaa$_1$-Xaa$_2$-Phe-Xaa$_4$-Phe-Ala-Glu-Gln- (SEQ ID NO:1176)
[linker]-Thr-Val-Gly-Trp-Val-Glu-Arg-His-Arg-Lys-Met-Leu-Arg-(OH)NH$_2$ e207) RNH-Lys-Ser-Met-Gln-Xaa$_3$-Pro-Phe-Ser-Arg-Xaa$_1$-Xaa$_2$-Phe-Xaa$_4$-Phe-Ala-Glu-Gln- (SEQ ID NO:1177)
[linker]-Thr-Val-Gly-Trp-Val-Glu-Arg-His-Arg-Lys-Met-Leu-Arg-(OH)NH$_2$ e208) RNH-Lys-Ser-Met-Gln-Val-Xaa$_3$-Phe-Ser-Arg-Xaa$_1$-Xaa$_2$-Phe-Xaa$_4$-Phe-Ala-Glu-Gln- (SEQ ID NO:1178)
[linker]-Thr-Val-Gly-Trp-Val-Glu-Arg-His-Arg-Lys-Met-Leu-Arg-(OH)NH$_2$ e209) RNH-Lys-Ser-Met-Gln-Val-Pro-Xaa$_3$-Ser-Arg-Xaa$_1$-Xaa$_2$-Phe-Xaa$_4$-Phe-Ala-Glu-Gln- (SEQ ID NO:1179)
[linker]-Thr-Val-Gly-Trp-Val-Glu-Arg-His-Arg-Lys-Met-Leu-Arg-(OH)NH$_2$ e210) RNH-Lys-Ser-Met-Gln-Val-Pro-Phe-Xaa$_3$-Arg-Xaa$_1$-Xaa$_2$-Phe-Xaa$_4$-Phe-Ala-Glu-Gln- (SEQ ID NO:1180)
[linker]-Thr-Val-Gly-Trp-Val-Glu-Arg-His-Arg-Lys-Met-Leu-Arg-(OH)NH$_2$ e211) RNH-Lys-Ser-Met-Gln-Val-Pro-Phe-Ser-Xaa$_3$-Xaa$_1$-Xaa$_2$-Phe-Xaa$_4$-Phe-Ala-Glu-Gln- (SEQ ID NO:1181)
[linker]-Thr-Val-Gly-Trp-Val-Glu-Arg-His-Arg-Lys-Met-Leu-Arg-(OH)NH$_2$ e213) RNH-Lys-Ser-Met-Gln-Val-Pro-Phe-Ser-Arg-Cys-Cys-Phe-Ser-Xaa$_4$-Ala-Glu-Gln- (SEQ ID NO:1182)
[linker]-Thr-Val-Gly-Trp-Val-Glu-Arg-His-Arg-Lys-Met-Leu-Arg-(OH)NH$_2$ e214) RNH-Lys-Ser-Met-Gln-Val-Pro-Phe-Ser-Arg-Xaa$_1$-Xaa$_2$-Phe-Ser-Xaa$_4$-Ala-Glu-Gln- (SEQ ID NO:1183)
[linker]-Thr-Val-Gly-Trp-Val-Glu-Arg-His-Arg-Lys-Met-Leu-Arg-(OH)NH$_2$ e215) RNH-Xaa$_3$-Ser-Met-Gln-Val-Pro-Phe-Ser-Arg-Xaa$_1$-Xaa$_2$-Phe-Ser-Xaa$_4$-Ala-Glu-Gln- (SEQ ID NO:1184)
[linker]-Thr-Val-Gly-Trp-Val-Glu-Arg-His-Arg-Lys-Met-Leu-Arg-(OH)NH$_2$ e216) RNH-Lys-Xaa$_3$-Met-Gln-Val-Pro-Phe-Ser-Arg-Xaa$_1$-Xaa$_2$-Phe-Ser-Xaa$_4$-Ala-Glu-Gln- (SEQ ID NO:1185)
[linker]-Thr-Val-Gly-Trp-Val-Glu-Arg-His-Arg-Lys-Met-Leu-Arg-(OH)NH$_2$ e217) RNH-Lys-Ser-Xaa$_3$-Gln-Val-Pro-Phe-Ser-Arg-Xaa$_1$-Xaa$_2$-Phe-Ser-Xaa$_4$-Ala-Glu-Gln- (SEQ ID NO:1186)
[linker]-Thr-Val-Gly-Trp-Val-Glu-Arg-His-Arg-Lys-Met-Leu-Arg-(OH)NH$_2$ e218) RNH-Lys-Ser-Met-Xaa$_3$-Val-Pro-Phe-Ser-Arg-Xaa$_1$-Xaa$_2$-Phe-Ser-Xaa$_4$-Ala-Glu-Gln- (SEQ ID NO:1187)
[linker]-Thr-Val-Gly-Trp-Val-Glu-Arg-His-Arg-Lys-Met-Leu-Arg-(OH)NH$_2$ e219) RNH-Lys-Ser-Met-Gln-Xaa$_3$-Pro-Phe-Ser-Arg-Xaa$_1$-Xaa$_2$-Phe-Ser-Xaa$_4$-Ala-Glu-Gln- (SEQ ID NO:1188)
[linker]-Thr-Val-Gly-Trp-Val-Glu-Arg-His-Arg-Lys-Met-Leu-Arg-(OH)NH$_2$ e220) RNH-Lys-Ser-Met-Gln-Val-Xaa$_3$-Phe-Ser-Arg-Xaa$_1$-Xaa$_2$-Phe-Ser-Xaa$_4$-Ala-Glu-Gln- (SEQ ID NO:1189)
[linker]-Thr-Val-Gly-Trp-Val-Glu-Arg-His-Arg-Lys-Met-Leu-Arg-(OH)NH$_2$ e221) RNH-Lys-Ser-Met-Gln-Val-Pro-Xaa$_3$-Ser-Arg-Xaa$_1$-Xaa$_2$-Phe-Ser-Xaa$_4$-Ala-Glu-Gln- (SEQ ID NO:1190)
[linker]-Thr-Val-Gly-Trp-Val-Glu-Arg-His-Arg-Lys-Met-Leu-Arg-(OH)NH$_2$ e222) RNH-Lys-Ser-Met-Gln-Val-Pro-Phe-Xaa$_3$-Arg-Xaa$_1$-Xaa$_2$-Phe-Ser-Xaa$_4$-Ala-Glu-Gln- (SEQ ID NO:1191)
[linker]-Thr-Val-Gly-Trp-Val-Glu-Arg-His-Arg-Lys-Met-Leu-Arg-(OH)NH$_2$ e223) RNH-Lys-Ser-Met-Gln-Val-Pro-Phe-Ser-Xaa$_3$-Xaa$_1$-Xaa$_2$-Phe-Ser-Xaa$_4$-Ala-Glu-Gln- (SEQ ID NO:1192)
[linker]-Thr-Val-Gly-Trp-Val-Glu-Arg-His-Arg-Lys-Met-Leu-Arg-(OH)NH$_2$ e224) RNH-Lys-Ser-Met-Gln-Val-Pro-Phe-Ser-Arg-Cys-Cys-Phe-Ser-Phe-Xaa$_4$-Glu-Gln- (SEQ ID NO:1193)
[linker]-Thr-Val-Gly-Trp-Val-Glu-Arg-His-Arg-Lys-Met-Leu-Arg-(OH)NH$_2$ e225) RNH-Lys-Ser-Met-Gln-Val-Pro-Phe-Ser-Arg-Xaa$_1$-Xaa$_2$-Phe-Ser-Phe-Xaa$_4$-Glu-Gln- (SEQ ID NO:1194)
[linker]-Thr-Val-Gly-Trp-Val-Glu-Arg-His-Arg-Lys-Met-Leu-Arg-(OH)NH$_2$ e226) RNH-Xaa$_3$-Ser-Met-Gln-Val-Pro-Phe-Ser-Arg-Xaa$_1$-Xaa$_2$-Phe-Ser-Phe-Xaa$_4$-Glu-Gln- (SEQ ID NO:1195)
[linker]-Thr-Val-Gly-Trp-Val-Glu-Arg-His-Arg-Lys-Met-Leu-Arg-(OH)NH$_2$ e227) RNH-Lys-Xaa$_3$-Met-Gln-Val-Pro-Phe-Ser-Arg-Xaa$_1$-Xaa$_2$-Phe-Ser-Phe-Xaa$_4$-Glu-Gln- (SEQ ID NO:1196)
[linker]-Thr-Val-Gly-Trp-Val-Glu-Arg-His-Arg-Lys-Met-Leu-Arg-(OH)NH$_2$ e228) RNH-Lys-Ser-Xaa$_3$-Gln-Val-Pro-Phe-Ser-Arg-Xaa$_1$-Xaa$_2$-Phe-Ser-Phe-Xaa$_4$-Glu-Gln- (SEQ ID NO:1197)
[linker]-Thr-Val-Gly-Trp-Val-Glu-Arg-His-Arg-Lys-Met-Leu-Arg-(OH)NH$_2$ e229) RNH-Lys-Ser-Met-Xaa$_3$-Val-Pro-Phe-Ser-Arg-Xaa$_1$-Xaa$_2$-Phe-Ser-Phe-Xaa$_4$-Glu-Gln- (SEQ ID NO:1198)
[linker]-Thr-Val-Gly-Trp-Val-Glu-Arg-His-Arg-Lys-Met-Leu-Arg-(OH)NH$_2$ e230) RNH-Lys-Ser-Met-Gln-Xaa$_3$-Pro-Phe-Ser-Arg-Xaa$_1$-Xaa$_2$-Phe-Ser-Phe-Xaa$_4$-Glu-Gln- (SEQ ID NO:1199)
[linker]-Thr-Val-Gly-Trp-Val-Glu-Arg-His-Arg-Lys-Met-Leu-Arg-(OH)NH$_2$ -continued

```
e231)  RNH-Lys-Ser-Met-Gln-Val-Xaa₃-Phe-Ser-Arg-Xaa₁-Xaa₂-Phe-Ser-Phe-Xaa₄-Glu-Gln-       (SEQ ID NO:1200)
       [linker]-Thr-Val-Gly-Trp-Val-Glu-Arg-His-Arg-Lys-Met-Leu-Arg-(OH)NH₂ e232)  RNH-Lys-Ser-Met-Gln-Val-Pro-Xaa₃-Ser-Arg-Xaa₁-Xaa₂-Phe-Ser-Phe-Xaa₄-Glu-Gln-       (SEQ ID NO:1201)
       [linker]-Thr-Val-Gly-Trp-Val-Glu-Arg-His-Arg-Lys-Met-Leu-Arg-(OH)NH₂ e233)  RNH-Lys-Ser-Met-Gln-Val-Pro-Phe-Xaa₃-Arg-Xaa₁-Xaa₂-Phe-Ser-Phe-Xaa₄-Glu-Gln-       (SEQ ID NO:1202)
       [linker]-Thr-Val-Gly-Trp-Val-Glu-Arg-His-Arg-Lys-Met-Leu-Arg-(OH)NH₂ e234)  RNH-Lys-Ser-Met-Gln-Val-Pro-Phe-Ser-Xaa₃-Xaa₁-Xaa₂-Phe-Ser-Phe-Xaa₄-Glu-Gln-       (SEQ ID NO:1203)
       [linker]-Thr-Val-Gly-Trp-Val-Glu-Arg-His-Arg-Lys-Met-Leu-Arg-(OH)NH₂ e235)  RNH-Lys-Ser-Met-Gln-Val-Pro-Phe-Ser-Arg-Cys-Cys-Phe-Ser-Phe-Ala-Xaa₄-Gln-         (SEQ ID NO:1204)
       [linker]-Thr-Val-Gly-Trp-Val-Glu-Arg-His-Arg-Lys-Met-Leu-Arg-(OH)NH₂ e236)  RNH-Lys-Ser-Met-Gln-Val-Pro-Phe-Ser-Arg-Xaa₁-Xaa₂-Phe-Ser-Phe-Ala-Xaa₄-Gln-       (SEQ ID NO:1205)
       [linker]-Thr-Val-Gly-Trp-Val-Glu-Arg-His-Arg-Lys-Met-Leu-Arg-(OH)NH₂ e237)  RNH-Xaa₃-Ser-Met-Gln-Val-Pro-Phe-Ser-Arg-Xaa₁-Xaa₂-Phe-Ser-Phe-Ala-Xaa₄-Gln-       (SEQ ID NO:1206)
       [linker]-Thr-Val-Gly-Trp-Val-Glu-Arg-His-Arg-Lys-Met-Leu-Arg-(OH)NH₂ e238)  RNH-Lys-Xaa₃-Met-Gln-Val-Pro-Phe-Ser-Arg-Xaa₁-Xaa₂-Phe-Ser-Phe-Ala-Xaa₄-Gln-       (SEQ ID NO:1207)
       [linker]-Thr-Val-Gly-Trp-Val-Glu-Arg-His-Arg-Lys-Met-Leu-Arg-(OH)NH₂ e239)  RNH-Lys-Ser-Xaa₃-Gln-Val-Pro-Phe-Ser-Arg-Xaa₁-Xaa₂-Phe-Ser-Phe-Ala-Xaa₄-Gln-       (SEQ ID NO:1208)
       [linker]-Thr-Val-Gly-Trp-Val-Glu-Arg-His-Arg-Lys-Met-Leu-Arg-(OH)NH₂ e240)  RNH-Lys-Ser-Met-Xaa₃-Val-Pro-Phe-Ser-Arg-Xaa₁-Xaa₂-Phe-Ser-Phe-Ala-Xaa₄-Gln-       (SEQ ID NO:1209)
       [linker]-Thr-Val-Gly-Trp-Val-Glu-Arg-His-Arg-Lys-Met-Leu-Arg-(OH)NH₂ e241)  RNH-Lys-Ser-Met-Gln-Val-Pro-Phe-Ser-Arg-Cys-Cys-Phe-Ser-Phe-Ala-Glu-Xaa₄-         (SEQ ID NO:1210)
       [linker]-Thr-Val-Gly-Trp-Val-Glu-Arg-His-Arg-Lys-Met-Leu-Arg-(OH)NH₂ e242)  RNH-Lys-Ser-Met-Gln-Val-Pro-Phe-Ser-Arg-Xaa₁-Xaa₂-Phe-Ser-Phe-Ala-Glu-Xaa₄-       (SEQ ID NO:1211)
       [linker]-Thr-Val-Gly-Trp-Val-Glu-Arg-His-Arg-Lys-Met-Leu-Arg-(OH)NH₂ e243)  RNH-Xaa₃-Ser-Met-Gln-Val-Pro-Phe-Ser-Arg-Xaa₁-Xaa₂-Phe-Ser-Phe-Ala-Glu-Xaa₄-       (SEQ ID NO:1212)
       [linker]-Thr-Val-Gly-Trp-Val-Glu-Arg-His-Arg-Lys-Met-Leu-Arg-(OH)NH₂ e244)  RNH-Lys-Xaa₃-Met-Gln-Val-Pro-Phe-Ser-Arg-Xaa₁-Xaa₂-Phe-Ser-Phe-Ala-Glu-Xaa₄-       (SEQ ID NO:1213)
       [linker]-Thr-Val-Gly-Trp-Val-Glu-Arg-His-Arg-Lys-Met-Leu-Arg-(OH)NH₂ e245)  RNH-Lys-Ser-Xaa₃-Gln-Val-Pro-Phe-Ser-Arg-Xaa₁-Xaa₂-Phe-Ser-Phe-Ala-Glu-Xaa₄-       (SEQ ID NO:1214)
       [linker]-Thr-Val-Gly-Trp-Val-Glu-Arg-His-Arg-Lys-Met-Leu-Arg-(OH)NH₂ e246)  RNH-Lys-Ser-Met-Xaa₃-Val-Pro-Phe-Ser-Arg-Xaa₁-Xaa₂-Phe-Ser-Phe-Ala-Glu-Xaa₄-       (SEQ ID NO:1215)
       [linker]-Thr-Val-Gly-Trp-Val-Glu-Arg-His-Arg-Lys-Met-Leu-Arg-(OH)NH₂ e247)  RNH-Lys-Ser-Met-Gln-Xaa₃-Pro-Phe-Ser-Arg-Xaa₁-Xaa₂-Phe-Ser-Phe-Ala-Glu-Xaa₄-       (SEQ ID NO:1216)
       [linker]-Thr-Val-Gly-Trp-Val-Glu-Arg-His-Arg-Lys-Met-Leu-Arg-(OH)NH₂ e248)  RNH-Lys-Ser-Met-Gln-Val-Xaa₃-Phe-Ser-Arg-Xaa₁-Xaa₂-Phe-Ser-Phe-Ala-Glu-Xaa₄-       (SEQ ID NO:1217)
       [linker]-Thr-Val-Gly-Trp-Val-Glu-Arg-His-Arg-Lys-Met-Leu-Arg-(OH)NH₂ e249)  RNH-Lys-Ser-Met-Gln-Val-Pro-Xaa₃-Ser-Arg-Xaa₁-Xaa₂-Phe-Ser-Phe-Ala-Glu-Xaa₄-       (SEQ ID NO:1218)
       [linker]-Thr-Val-Gly-Trp-Val-Glu-Arg-His-Arg-Lys-Met-Leu-Arg-(OH)NH₂ e250)  RNH-Lys-Ser-Met-Gln-Val-Pro-Phe-Xaa₃-Arg-Xaa₁-Xaa₂-Phe-Ser-Phe-Ala-Glu-Xaa₄-       (SEQ ID NO:1219)
       [linker]-Thr-Val-Gly-Trp-Val-Glu-Arg-His-Arg-Lys-Met-Leu-Arg-(OH)NH₂ e251)  RNH-Lys-Ser-Met-Gln-Val-Pro-Phe-Ser-Xaa₃-Xaa₁-Xaa₂-Phe-Ser-Phe-Ala-Glu-Xaa₄-       (SEQ ID NO:1220)
       [linker]-Thr-Val-Gly-Trp-Val-Glu-Arg-His-Arg-Lys-Met-Leu-Arg-(OH)NH₂
```

Preferred embodiments of cyclic I-309 analogs of the present invention corresponding to a cyclic portion of the internal region of I-309 having the following structures:

[Ala²⁶]-I-309-(26–49) cyclic(Glu37–Lys42) acid or amide
```
e252)    RNH-Ala-Tyr-Arg-Asn-Thr-Ser-Ser-Ile-Cys-Ser-Asn-Glu-Gly-Leu-Ile-Phe-Lys-Leu-    (SEQ ID NO:1221)
         Lys-Arg-Gly-Lys-Glu-Ala-(OH)NH₂
```

[Ala²⁶]-I-309-(26–49) cyclic(Glu37–Lys44) acid or amide
```
e253)    RNH-Ala-Tyr-Arg-Asn-Thr-Ser-Ser-Ile-Cys-Ser-Asn-Glu-Gly-Leu-Ile-Phe-Lys-Leu-    (SEQ ID NO:1222)
         Lys-Arg-Gly-Lys-Glu-Ala-(OH)NH₂
```

-continued

[Ala²⁶]-I-309-(26–49) cyclic(Glu37–Lys47) acid or amide
e254)   RNH-Ala-Tyr-Arg-Asn-Thr-Ser-Ser-Ile-Cys-Ser-Asn-<u>Glu</u>-Gly-Leu-Ile-Phe-Lys-Leu-   (SEQ ID NO:1223)
        Lys-Arg-Gly-<u>Lys</u>-Glu-Ala-(OH)NH₂

Preferred embodiments of cyclic I-309 analogs of the present invention corresponding to a cyclic portion of the N-terminal region and the internal region of I-309 having the following structures:

I-309-(1–25) cyclic(Lys1–Glu18) acid or amide
e256)   RNH-<u>Lys</u>-Ser-Met-Gln-Val-Pro-Phe-Ser-Arg-Cys-Cys-Phe-Ser-Phe-Ala-<u>Glu</u>-Gln-Glu-   (SEQ ID NO:1224)
        Ile-Pro-Leu-Arg-Ala-Ile-Leu-(OH)NH₂ e257)   RNH-<u>Lys</u>-Ser-Met-Gln-Val-Pro-Phe-Ser-Arg-Xaa₁-Xaa₂-Phe-Ser-Phe-Ala-<u>Glu</u>-Gln-   (SEQ ID NO:1225)
        Glu-Ile-Pro-Leu-Arg-Ala-Ile-Leu-(OH)NH₂

I-309-(1–25) cyclic(Lys1–Glu20) acid or amide
e258)   RNH-<u>Lys</u>-Ser-Met-Gln-Val-Pro-Phe-Ser-Arg-Cys-Cys-Phe-Ser-Phe-Ala-Glu-Gln-<u>Glu</u>-   (SEQ ID NO:1226)
        Ile-Pro-Leu-Arg-Ala-Ile-Leu-(OH)NH₂ e259)   RNH-<u>Lys</u>-Ser-Met-Gln-Val-Pro-Phe-Ser-Arg-Xaa₁-Xaa₂-Phe-Ser-Phe-Ala-Glu-Gln-   (SEQ ID NO:1227)
        <u>Glu</u>-Ile-Pro-Leu-Arg-Ala-Ile-Leu-(OH)NH₂

Preferred embodiments of cyclic I-309 analogs of the present invention corresponding to a cyclic portion of the C-terminal region of I-309 having the following structures:

[Ala³⁴]-I-309-(34–67) cyclic(Glu37–Lys42) acid or amide
e260)   RNH-Ala-Ser-Asn-<u>Glu</u>-Gly-Leu-Ile-Phe-<u>Lys</u>-Leu-Lys-Arg-Gly-Lys-Glu-Ala-Cys-Ala-   (SEQ ID NO:1228)
        Leu-Asp-Thr-Val-Gly-Trp-Val-Gln-Arg-His-Arg-Lys-Met-Leu-Arg-His-(OH)NH₂

[Ala³⁴]-I-309-(34–67) cyclic(Glu37–Lys44) acid or amide
e261)   RNH-Ala-Ser-Asn-<u>Glu</u>-Gly-Leu-Ile-Phe-Lys-Leu-<u>Lys</u>-Arg-Gly-Lys-Glu-Ala-Cys-Ala-   (SEQ ID NO:1229)
        Leu-Asp-Thr-Val-Gly-Trp-Val-Gln-Arg-His-Arg-Lys-Met-Leu-Arg-(OH)NH₂

[Ala³⁴]-I-309-(34–67) cyclic(Glu37–Lys47) acid or amide
e262)   RNH-Ala-Ser-Asn-<u>Glu</u>-Gly-Leu-Ile-Phe-Lys-Leu-Lys-Arg-Gly-<u>Lys</u>-Glu-Ala-Cys-Ala-   (SEQ ID NO:1230)
        Leu-Asp-Thr-Val-Gly-Trp-Val-Gln-Arg-His-Arg-Lys-Met-Leu-Arg-(OH)NH₂

[Ala³⁴]-I-309-(34–67) cyclic(Glu37–Lys63) acid or amide
e263)   RNH-Ala-Ser-Asn-<u>Glu</u>-Gly-Leu-Ile-Phe-Lys-Leu-Lys-Arg-Gly-Lys-Glu-Ala-Cys-Ala-   (SEQ ID NO:1231)
        Leu-Asp-Thr-Val-Gly-Trp-Val-Gln-Arg-His-Arg-<u>Lys</u>-Met-Leu-Arg-(OH)NH₂

[Ala³⁴]-I-309-(34–67) cyclic(Glu48–Lys63) acid or amide
e264)   RNH-Ala-Ser-Asn-Glu-Gly-Leu-Ile-Phe-Lys-Leu-Lys-Arg-Gly-Lys-<u>Glu</u>-Ala-Cys-Ala-   (SEQ ID NO:1232)
        Leu-Asp-Thr-Val-Gly-Trp-Val-Gln-Arg-His-Arg-<u>Lys</u>-Met-Leu-Arg-(OH)NH₂

[Ala³⁴]-I-309-(34–67) cyclic(Lys44–Glu48) acid or amide
e265)   RNH-Ala-Ser-Asn-Glu-Gly-Leu-Ile-Phe-Lys-Leu-<u>Lys</u>-Arg-Gly-Lys-<u>Glu</u>-Ala-Cys-Ala-   (SEQ ID NO:1233)
        Leu-Asp-Thr-Val-Gly-Trp-Val-Gln-Arg-His-Arg-Lys-Met-Leu-Arg-(OH)NH₂

[Ala³⁴]-I-309-(34–67) cyclic(Lys42–Glu48) acid or amide
e266)   RNH-Ala-Ser-Asn-Glu-Gly-Leu-Ile-Phe-<u>Lys</u>-Leu-Lys-Arg-Gly-Lys-<u>Glu</u>-Ala-Cys-Ala-   (SEQ ID NO:1234)
        Leu-Asp-Thr-Val-Gly-Trp-Val-Gln-Arg-His-Arg-Lys-Met-Leu-Arg-(OH)NH₂

Preferred embodiments of cyclic I-309 analogs of the present invention corresponding to a portion the N-terminal region joined with a linker to a cyclic portion of the C-terminal region of I-309 having the following structures (underlined residues are cyclized):

[Glu⁵⁷]-I-309-(1–14)-[linker]-[Glu⁵⁷]-I-309-(52–62) cyclic(Glu57–Lys61) acid or amide
e267)   RNH-Lys-Ser-Met-Gln-Val-Pro-Phe-Ser-Arg-Cys-Cys-Phe-Ser-Phe-[linker]-Thr-   (SEQ ID NO:1235)
        Val-Gly-Trp-Val-<u>Glu</u>-Arg-His-Arg-<u>Lys</u>-Met-Leu-Arg-(OH)NH₂ e268)   RNH-Lys-Ser-Met-Gln-Val-Pro-Phe-Ser-Arg-Xaa₁-Xaa₂-Phe-Ser-Phe-[linker]-Thr-   (SEQ ID NO:1236)
        Val-Gly-Trp-Val-<u>Glu</u>-Arg-His-Arg-<u>Lys</u>-Met-Leu-Arg-(OH)NH₂

```
e269)  RNH-Xaa₃-Ser-Met-Gln-Val-Pro-Phe-Ser-Arg-Xaa₁-Xaa₂-Phe-Ser-Phe-[linker]-Thr-     (SEQ ID NO:1237)
       Val-Gly-Trp-Val-Glu-Arg-His-Arg-Lys-Met-Leu-Arg-(OH)NH₂ e270)  RNH-Lys-Xaa₃-Met-Gln-Val-Pro-Phe-Ser-Arg-Xaa₁-Xaa₂-Phe-Ser-Phe-[linker]-Thr-     (SEQ ID NO:1238)
       Val-Gly-Trp-Val-Glu-Arg-His-Arg-Lys-Met-Leu-Arg-(OH)NH₂ e271)  RNH-Lys-Ser-Xaa₃-Gln-Val-Pro-Phe-Ser-Arg-Xaa₁-Xaa₂-Phe-Ser-Phe-[linker]-Thr-     (SEQ ID NO:1239)
       Val-Gly-Trp-Val-Glu-Arg-His-Arg-Lys-Met-Leu-Arg-(OH)NH₂ e272)  RNH-Lys-Ser-Met-Xaa₃-Val-Pro-Phe-Ser-Arg-Xaa₁-Xaa₂-Phe-Ser-Phe-[linker]-Thr-     (SEQ ID NO:1240)
       Val-Gly-Trp-Val-Glu-Arg-His-Arg-Lys-Met-Leu-Arg-(OH)NH₂ e273)  RNH-Lys-Ser-Met-Gln-Xaa₃-Pro-Phe-Ser-Arg-Xaa₁-Xaa₂-Phe-Ser-Phe-[linker]-Thr-     (SEQ ID NO:1241)
       Val-Gly-Trp-Val-Glu-Arg-His-Arg-Lys-Met-Leu-Arg-(OH)NH₂ e274)  RNH-Lys-Ser-Met-Gln-Val-Xaa₃-Phe-Ser-Arg-Xaa₁-Xaa₂-Phe-Ser-Phe-[linker]-Thr-     (SEQ ID NO:1242)
       Val-Gly-Trp-Val-Glu-Arg-His-Arg-Lys-Met-Leu-Arg-(OH)NH₂ e275)  RNH-Lys-Ser-Met-Gln-Val-Pro-Xaa₃-Ser-Arg-Xaa₁-Xaa₂-Phe-Ser-Phe-[linker]-Thr-     (SEQ ID NO:1243)
       Val-Gly-Trp-Val-Glu-Arg-His-Arg-Lys-Met-Leu-Arg-(OH)NH₂ e276)  RNH-Lys-Ser-Met-Gln-Val-Pro-Phe-Xaa₃-Arg-Xaa₁-Xaa₂-Phe-Ser-Phe-[linker]-Thr-     (SEQ ID NO:1244)
       Val-Gly-Trp-Val-Glu-Arg-His-Arg-Lys-Met-Leu-Arg-(OH)NH₂ e277)  RNH-Lys-Ser-Met-Gln-Val-Pro-Phe-Ser-Xaa₃-Xaa₁-Xaa₂-Phe-Ser-Phe-[linker]-Thr-     (SEQ ID NO:1245)
       Val-Gly-Trp-Val-Glu-Arg-His-Arg-Lys-Met-Leu-Arg-(OH)NH₂ e278)  RNH-Lys-Ser-Met-Gln-Val-Pro-Phe-Ser-Arg-Cys-Cys-Xaa₄-Ser-Phe-[linker]-Thr-       (SEQ ID NO:1246)
       Val-Gly-Trp-Val-Glu-Arg-His-Arg-Lys-Met-Leu-Arg-(OH)NH₂ e279)  RNH-Lys-Ser-Met-Gln-Val-Pro-Phe-Ser-Arg-Xaa₁-Xaa₂-Xaa₄-Ser-Phe-[linker]-Thr-     (SEQ ID NO:1247)
       Val-Gly-Trp-Val-Glu-Arg-His-Arg-Lys-Met-Leu-Arg-(OH)NH₂ e280)  RNH-Xaa₃-Ser-Met-Gln-Val-Pro-Phe-Ser-Arg-Xaa₁-Xaa₂-Xaa₄-Ser-Phe-[linker]-Thr-    (SEQ ID NO:1248)
       Val-Gly-Trp-Val-Glu-Arg-His-Arg-Lys-Met-Leu-Arg-(OH)NH₂ e281)  RNH-Lys-Xaa₃-Met-Gln-Val-Pro-Phe-Ser-Arg-Xaa₁-Xaa₂-Xaa₄-Ser-Phe-[linker]-Thr-    (SEQ ID NO:1249)
       Val-Gly-Trp-Val-Glu-Arg-His-Arg-Lys-Met-Leu-Arg-(OH)NH₂ e282)  RNH-Lys-Ser-Xaa₃-Gln-Val-Pro-Phe-Ser-Arg-Xaa₁-Xaa₂-Xaa₄-Ser-Phe-[linker]-Thr-    (SEQ ID NO:1250)
       Val-Gly-Trp-Val-Glu-Arg-His-Arg-Lys-Met-Leu-Arg-(OH)NH₂ e283)  RNH-Lys-Ser-Met-Xaa₃-Val-Pro-Phe-Ser-Arg-Xaa₁-Xaa₂-Xaa₄-Ser-Phe-[linker]-Thr-    (SEQ ID NO:1251)
       Val-Gly-Trp-Val-Glu-Arg-His-Arg-Lys-Met-Leu-Arg-(OH)NH₂ e284)  RNH-Lys-Ser-Met-Gln-Xaa₃-Pro-Phe-Ser-Arg-Xaa₁-Xaa₂-Xaa₄-Ser-Phe-[linker]-Thr-    (SEQ ID NO:1252)
       Val-Gly-Trp-Val-Glu-Arg-His-Arg-Lys-Met-Leu-Arg-(OH)NH₂ e285)  RNH-Lys-Ser-Met-Gln-Val-Xaa₃-Phe-Ser-Arg-Xaa₁-Xaa₂-Xaa₄-Ser-Phe-[linker]-Thr-    (SEQ ID NO:1253)
       Val-Gly-Trp-Val-Glu-Arg-His-Arg-Lys-Met-Leu-Arg-(OH)NH₂ e286)  RNH-Lys-Ser-Met-Gln-Val-Pro-Xaa₃-Ser-Arg-Xaa₁-Xaa₂-Xaa₄-Ser-Phe-[linker]-Thr-    (SEQ ID NO:1254)
       Val-Gly-Trp-Val-Glu-Arg-His-Arg-Lys-Met-Leu-Arg-(OH)NH₂ e287)  RNH-Lys-Ser-Met-Gln-Val-Pro-Phe-Xaa₃-Arg-Xaa₁-Xaa₂-Xaa₄-Ser-Phe-[linker]-Thr-    (SEQ ID NO:1255)
       Val-Gly-Trp-Val-Glu-Arg-His-Arg-Lys-Met-Leu-Arg-(OH)NH₂ e288)  RNH-Lys-Ser-Met-Gln-Val-Pro-Phe-Ser-Xaa₃-Xaa₁-Xaa₂-Xaa₄-Ser-Phe-[linker]-Thr-    (SEQ ID NO:1256)
       Val-Gly-Trp-Val-Glu-Arg-His-Arg-Lys-Met-Leu-Arg-(OH)NH₂ e289)  RNH-Lys-Ser-Met-Gln-Val-Pro-Phe-Ser-Arg-Cys-Cys-Phe-Xaa₄-Phe-[linker]-Thr-       (SEQ ID NO:1257)
       Val-Gly-Trp-Val-Glu-Arg-His-Arg-Lys-Met-Leu-Arg-(OH)NH₂ e290)  RNH-Lys-Ser-Met-Gln-Val-Pro-Phe-Ser-Arg-Xaa₁-Xaa₂-Phe-Xaa₄-[linker]-Thr-         (SEQ ID NO:1258)
       Val-Gly-Trp-Val-Glu-Arg-His-Arg-Lys-Met-Leu-Arg-(OH)NH₂ e291)  RNH-Xaa₃-Ser-Met-Gln-Val-Pro-Phe-Ser-Arg-Xaa₁-Xaa₂-Phe-Xaa₄-Phe-[linker]-Thr-    (SEQ ID NO:1259)
       Val-Gly-Trp-Val-Glu-Arg-His-Arg-Lys-Met-Leu-Arg-(OH)NH₂ e292)  RNH-Lys-Xaa₃-Met-Gln-Val-Pro-Phe-Ser-Arg-Xaa₁-Xaa₂-Phe-Xaa₄-Phe-[linker]-Thr-    (SEQ ID NO:1260)
       Val-Gly-Trp-Val-Glu-Arg-His-Arg-Lys-Met-Leu-Arg-(OH)NH₂ e293)  RNH-Lys-Ser-Xaa₃-Gln-Val-Pro-Phe-Ser-Arg-Xaa₁-Xaa₂-Phe-Xaa₄-Phe-[linker]-Thr-    (SEQ ID NO:1261)
       Val-Gly-Trp-Val-Glu-Arg-His-Arg-Lys-Met-Leu-Arg-(OH)NH₂ e294)  RNH-Lys-Ser-Met-Xaa₃-Val-Pro-Phe-Ser-Arg-Xaa₁-Xaa₂-Phe-Xaa₄-Phe-[linker]-Thr-    (SEQ ID NO:1262)
       Val-Gly-Trp-Val-Glu-Arg-His-Arg-Lys-Met-Leu-Arg-(OH)NH₂ e295)  RNH-Lys-Ser-Met-Gln-Xaa₃-Pro-Phe-Ser-Arg-Xaa₁-Xaa₂-Phe-Xaa₄-Phe-[linker]-Thr-    (SEQ ID NO:1263)
       Val-Gly-Trp-Val-Glu-Arg-His-Arg-Lys-Met-Leu-Arg-(OH)NH₂
```

-continued e296) RNH-Lys-Ser-Met-Gln-Val-Xaa$_3$-Phe-Ser-Arg-Xaa$_1$-Xaa$_2$-Phe-Xaa$_4$-Phe-[linker]-Thr- (SEQ ID NO:1264)
Val-Gly-Trp-Val-<u>Glu</u>-Arg-His-Arg-<u>Lys</u>-Met-Leu-Arg-(OH)NH$_2$ e297) RNH-Lys-Ser-Met-Gln-Val-Pro-Xaa$_3$-Ser-Arg-Xaa$_1$-Xaa$_2$-Phe-Xaa$_4$-Phe-[linker]-Thr- (SEQ ID NO:1265)
Val-Gly-Trp-Val-<u>Glu</u>-Arg-His-Arg-<u>Lys</u>-Met-Leu-Arg-(OH)NH$_2$ e298) RNH-Lys-Ser-Met-Gln-Val-Pro-Phe-Xaa$_3$-Arg-Xaa$_1$-Xaa$_2$-Phe-Xaa$_4$-Phe-[linker]-Thr- (SEQ ID NO:1266)
Val-Gly-Trp-Val-<u>Glu</u>-Arg-His-Arg-<u>Lys</u>-Met-Leu-Arg-(OH)NH$_2$ e299) RNH-Lys-Ser-Met-Gln-Val-Pro-Phe-Ser-Xaa$_3$-Xaa$_1$-Xaa$_2$-Phe-Xaa$_4$-Phe-[linker]-Thr- (SEQ ID NO:1267)
Val-Gly-Trp-Val-<u>Glu</u>-Arg-His-Arg-<u>Lys</u>-Met-Leu-Arg-(OH)NH$_2$ e300) RNH-Lys-Ser-Met-Gln-Val-Pro-Phe-Ser-Arg-Cys-Cys-Phe-Ser-Xaa$_4$-[linker]-Thr- (SEQ ID NO:1268)
Val-Gly-Trp-Val-<u>Glu</u>-Arg-His-Arg-<u>Lys</u>-Met-Leu-Arg-(OH)NH$_2$ e301) RNH-Lys-Ser-Met-Gln-Val-Pro-Phe-Ser-Arg-Xaa$_1$-Xaa$_2$-Phe-Ser-Xaa$_4$-[linker]-Thr- (SEQ ID NO:1269)
Val-Gly-Trp-Val-<u>Glu</u>-Arg-His-Arg-<u>Lys</u>-Met-Leu-Arg-(OH)NH$_2$ e302) RNH-Xaa$_3$-Ser-Met-Gln-Val-Pro-Phe-Ser-Arg-Xaa$_1$-Xaa$_2$-Phe-Ser-Xaa$_4$-[linker]-Thr- (SEQ ID NO:1270)
Val-Gly-Trp-Val-<u>Glu</u>-Arg-His-Arg-<u>Lys</u>-Met-Leu-Arg-(OH)NH$_2$ e303) RNH-Lys-Xaa$_3$-Met-Gln-Val-Pro-Phe-Ser-Arg-Xaa$_1$-Xaa$_2$-Phe-Ser-Xaa$_4$-[linker]-Thr- (SEQ ID NO:1271)
Val-Gly-Trp-Val-<u>Glu</u>-Arg-His-Arg-<u>Lys</u>-Met-Leu-Arg-(OH)NH$_2$ e304) RNH-Lys-Ser-Xaa$_3$-Gln-Val-Pro-Phe-Ser-Arg-Xaa$_1$-Xaa$_2$-Phe-Ser-Xaa$_4$-[linker]-Thr- (SEQ ID NO:1272)
Val-Gly-Trp-Val-<u>Glu</u>-Arg-His-Arg-<u>Lys</u>-Met-Leu-Arg-(OH)NH$_2$ e305) RNH-Lys-Ser-Met-Xaa$_3$-Val-Pro-Phe-Ser-Arg-Xaa$_1$-Xaa$_2$-Phe-Ser-Xaa$_4$-[linker]-Thr- (SEQ ID NO:1273)
Val-Gly-Trp-Val-<u>Glu</u>-Arg-His-Arg-<u>Lys</u>-Met-Leu-Arg-(OH)NH$_2$ e306) RNH-Lys-Ser-Met-Gln-Xaa$_3$-Pro-Phe-Ser-Arg-Xaa$_1$-Xaa$_2$-Phe-Ser-Xaa$_4$-[linker]-Thr- (SEQ ID NO:1274)
Val-Gly-Trp-Val-<u>Glu</u>-Arg-His-Arg-<u>Lys</u>-Met-Leu-Arg-(OH)NH$_2$ e307) RNH-Lys-Ser-Met-Gln-Val-Xaa$_3$-Phe-Ser-Arg-Xaa$_1$-Xaa$_2$-Phe-Ser-Xaa$_4$-[linker]-Thr- (SEQ ID NO:1275)
Val-Gly-Trp-Val-<u>Glu</u>-Arg-His-Arg-<u>Lys</u>-Met-Leu-Arg-(OH)NH$_2$ e308) RNH-Lys-Ser-Met-Gln-Val-Pro-Xaa$_3$-Ser-Arg-Xaa$_1$-Xaa$_2$-Phe-Ser-Xaa$_4$-[linker]-Thr- (SEQ ID NO:1276)
Val-Gly-Trp-Val-<u>Glu</u>-Arg-His-Arg-<u>Lys</u>-Met-Leu-Arg-(OH)NH$_2$ e309) RNH-Lys-Ser-Met-Gln-Val-Pro-Phe-Xaa$_3$-Arg-Xaa$_1$-Xaa$_2$-Phe-Ser-Xaa$_4$-[linker]-Thr- (SEQ ID NO:1277)
Val-Gly-Trp-Val-<u>Glu</u>-Arg-His-Arg-<u>Lys</u>-Met-Leu-Arg-(OH)NH$_2$ e310) RNH-Lys-Ser-Met-Gln-Val-Pro-Phe-Ser-Xaa$_3$-Xaa$_1$-Xaa$_2$-Phe-Ser-Xaa$_4$-[linker]-Thr- (SEQ ID NO:1278)
Val-Gly-Trp-Val-<u>Glu</u>-Arg-His-Arg-<u>Lys</u>-Met-Leu-Arg-(OH)NH$_2$

[Glu$^{57}$]-I-309-(1–17)-[linker]-[Glu$^{57}$]-I-309-(52–62) cyclic(Glu57-Lys61) acid or amide e311) RNH-Lys-Ser-Met-Gln-Val-Pro-Phe-Ser-Arg-Cys-Cys-Phe-Ser-Phe-Ala-Glu-Gln- (SEQ ID NO:1279)
[linker]-Thr-Val-Gly-Trp-Val-<u>Glu</u>-Arg-His-Arg-<u>Lys</u>-Met-Leu-Arg-(OH)NH$_2$ e312) RNH-Lys-Ser-Met-Gln-Val-Pro-Phe-Ser-Arg-Xaa$_1$-Xaa$_2$-Phe-Ser-Phe-Ala-Glu- (SEQ ID NO:1280)
Gln[linker]-Thr-Val-Gly-Trp-Val-<u>Glu</u>-Arg-His-Arg-<u>Lys</u>-Met-Leu-Arg-(OH)NH$_2$ e313) RNH-Xaa$_3$-Ser-Met-Gln-Val-Pro-Phe-Ser-Arg-Xaa$_1$-Xaa$_2$-Phe-Ser-Phe-Ala-Glu-Gln- (SEQ ID NO:1281)
[linker]-Thr-Val-Gly-Trp-Val-<u>Glu</u>-Arg-His-Arg-<u>Lys</u>-Met-Leu-Arg-(OH)NH$_2$ e314) RNH-Lys-Xaa$_3$-Met-Gln-Val-Pro-Phe-Ser-Arg-Xaa$_1$-Xaa$_2$-Phe-Ser-Phe-Ala-Glu-Gln- (SEQ ID NO:1282)
[linker]-Thr-Val-Gly-Trp-Val-<u>Glu</u>-Arg-His-Arg-<u>Lys</u>-Met-Leu-Arg-(OH)NH$_2$ e315) RNH-Lys-Ser-Xaa$_3$-Gln-Val-Pro-Phe-Ser-Arg-Xaa$_1$-Xaa$_2$-Phe-Ser-Phe-Ala-Glu-Gln- (SEQ ID NO:1283)
[linker]-Thr-Val-Gly-Trp-Val-<u>Glu</u>-Arg-His-Arg-<u>Lys</u>-Met-Leu-Arg-(OH)NH$_2$ e316) RNH-Lys-Ser-Met-Xaa$_3$-Val-Pro-Phe-Ser-Arg-Xaa$_1$-Xaa$_2$-Phe-Ser-Phe-Ala-Glu-Gln- (SEQ ID NO:1284)
[linker]-Thr-Val-Gly-Trp-Val-<u>Glu</u>-Arg-His-Arg-<u>Lys</u>-Met-Leu-Arg-(OH)NH$_2$ e317) RNH-Lys-Ser-Met-Gln-Xaa$_3$-Pro-Phe-Ser-Arg-Xaa$_1$-Xaa$_2$-Phe-Ser-Phe-Ala-Glu-Gln- (SEQ ID NO:1285)
[linker]-Thr-Val-Gly-Trp-Val-<u>Glu</u>-Arg-His-Arg-<u>Lys</u>-Met-Leu-Arg-(OH)NH$_2$ e318) RNH-Lys-Ser-Met-Gln-Val-Xaa$_3$-Phe-Ser-Arg-Xaa$_1$-Xaa$_2$-Phe-Ser-Phe-Ala-Glu-Gln- (SEQ ID NO:1286)
[linker]-Thr-Val-Gly-Trp-Val-<u>Glu</u>-Arg-His-Arg-<u>Lys</u>-Met-Leu-Arg-(OH)NH$_2$ e319) RNH-Lys-Ser-Met-Gln-Val-Pro-Xaa$_3$-Ser-Arg-Xaa$_1$-Xaa$_2$-Phe-Ser-Phe-Ala-Glu-Gln- (SEQ ID NO:1287)
[linker]-Thr-Val-Gly-Trp-Val-<u>Glu</u>-Arg-His-Arg-<u>Lys</u>-Met-Leu-Arg-(OH)NH$_2$ e320) RNH-Lys-Ser-Met-Gln-Val-Pro-Phe-Xaa$_3$-Arg-Xaa$_1$-Xaa$_2$-Phe-Ser-Phe-Ala-Glu-Gln- (SEQ ID NO:1288)
[linker]-Thr-Val-Gly-Trp-Val-<u>Glu</u>-Arg-His-Arg-<u>Lys</u>-Met-Leu-Arg-(OH)NH$_2$ e321) RNH-Lys-Ser-Met-Gln-Val-Pro-Phe-Ser-Xaa$_3$-Xaa$_1$-Xaa$_2$-Phe-Ser-Phe-Ala-Glu-Gln- (SEQ ID NO:1289)
[linker]-Thr-Val-Gly-Trp-Val-<u>Glu</u>-Arg-His-Arg-<u>Lys</u>-Met-Leu-Arg-(OH)NH$_2$ -continued e322) RNH-Lys-Ser-Met-Gln-Val-Pro-Phe-Ser-Arg-Cys-Cys-Xaa$_4$-Ser-Phe-Ala-Glu-Gln- (SEQ ID NO:1290)
[linker]-Thr-Val-Gly-Trp-Val-<u>Glu</u>-Arg-His-Arg-<u>Lys</u>-Met-Leu-Arg-(OH)NH$_2$ e323) RNH-Lys-Ser-Met-Gln-Val-Pro-Phe-Ser-Arg-Xaa$_1$-Xaa$_2$-Xaa$_4$-Ser-Phe-Ala-Glu-Gln- (SEQ ID NO:1291)
[linker]-Thr-Val-Gly-Trp-Val-<u>Glu</u>-Arg-His-Arg-<u>Lys</u>-Met-Leu-Arg-(OH)NH$_2$ e324) RNH-Xaa$_3$-Ser-Met-Gln-Val-Pro-Phe-Ser-Arg-Xaa$_1$-Xaa$_2$-Xaa$_4$-Ser-Phe-Ala-Glu-Gln- (SEQ ID NO:1292)
[linker]-Thr-Val-Gly-Trp-Val-<u>Glu</u>-Arg-His-Arg-<u>Lys</u>-Met-Leu-Arg-(OH)NH$_2$ e325) RNH-Lys-Xaa$_3$-Met-Gln-Val-Pro-Phe-Ser-Arg-Xaa$_1$-Xaa$_2$-Xaa$_4$-Ser-Phe-Ala-Glu-Gln- (SEQ ID NO:1293)
[linker]-Thr-Val-Gly-Trp-Val-<u>Glu</u>-Arg-His-Arg-<u>Lys</u>-Met-Leu-Arg-(OH)NH$_2$ e326) RNH-Lys-Ser-Xaa$_3$-Gln-Val-Pro-Phe-Ser-Arg-Xaa$_1$-Xaa$_2$-Xaa$_4$-Ser-Phe-Ala-Glu-Gln- (SEQ ID NO:1294)
[linker]-Thr-Val-Gly-Trp-Val-<u>Glu</u>-Arg-His-Arg-<u>Lys</u>-Met-Leu-Arg-(OH)NH$_2$ e327) RNH-Lys-Ser-Met-Xaa$_3$-Val-Pro-Phe-Ser-Arg-Xaa$_1$-Xaa$_2$-Xaa$_4$-Ser-Phe-Ala-Glu-Gln- (SEQ ID NO:1295)
[linker]-Thr-Val-Gly-Trp-Val-<u>Glu</u>-Arg-His-Arg-<u>Lys</u>-Met-Leu-Arg-(OH)NH$_2$ e328) RNH-Lys-Ser-Met-Gln-Xaa$_3$-Pro-Phe-Ser-Arg-Xaa$_1$-Xaa$_2$-Xaa$_4$-Ser-Phe-Ala-Glu-Gln- (SEQ ID NO:1296)
[linker]-Thr-Val-Gly-Trp-Val-<u>Glu</u>-Arg-His-Arg-<u>Lys</u>-Met-Leu-Arg-(OH)NH$_2$ e329) RNH-Lys-Ser-Met-Gln-Val-Xaa$_3$-Phe-Ser-Arg-Xaa$_1$-Xaa$_2$-Xaa$_4$-Ser-Phe-Ala-Glu-Gln- (SEQ ID NO:1297)
[linker]-Thr-Val-Gly-Trp-Val-<u>Glu</u>-Arg-His-Arg-<u>Lys</u>-Met-Leu-Arg-(OH)NH$_2$ e330) RNH-Lys-Ser-Met-Gln-Val-Pro-Xaa$_3$-Ser-Arg-Xaa$_1$-Xaa$_2$-Xaa$_4$-Ser-Phe-Ala-Glu-Gln- (SEQ ID NO:1298)
[linker]-Thr-Val-Gly-Trp-Val-<u>Glu</u>-Arg-His-Arg-<u>Lys</u>-Met-Leu-Arg-(OH)NH$_2$ e331) RNH-Lys-Ser-Met-Gln-Val-Pro-Phe-Xaa$_3$-Arg-Xaa$_1$-Xaa$_2$-Xaa$_4$-Ser-Phe-Ala-Glu-Gln- (SEQ ID NO:1299)
[linker]-Thr-Val-Gly-Trp-Val-<u>Glu</u>-Arg-His-Arg-<u>Lys</u>-Met-Leu-Arg-(OH)NH$_2$ e332) RNH-Lys-Ser-Met-Gln-Val-Pro-Phe-Ser-Xaa$_3$-Xaa$_1$-Xaa$_2$-Xaa$_4$-Ser-Phe-Ala-Glu-Gln- (SEQ ID NO:1300)
[linker]-Thr-Val-Gly-Trp-Val-<u>Glu</u>-Arg-His-Arg-<u>Lys</u>-Met-Leu-Arg-(OH)NH$_2$ e333) RNH-Lys-Ser-Met-Gln-Val-Pro-Phe-Ser-Arg-Cys-Cys-Phe-Xaa$_4$-Phe-Ala-Glu-Gln- (SEQ ID NO:1301)
[linker]-Thr-Val-Gly-Trp-Val-<u>Glu</u>-Arg-His-Arg-<u>Lys</u>-Met-Leu-Arg-(OH)NH$_2$ e334) RNH-Lys-Ser-Met-Gln-Val-Pro-Phe-Ser-Arg-Xaa$_1$-Xaa$_2$-Phe-Xaa$_4$-Phe-Ala-Glu-Gln- (SEQ ID NO:1302)
[linker]-Thr-Val-Gly-Trp-Val-<u>Glu</u>-Arg-His-Arg-<u>Lys</u>-Met-Leu-Arg-(OH)NH$_2$ e335) RNH-Xaa$_3$-Ser-Met-Gln-Val-Pro-Phe-Ser-Arg-Xaa$_1$-Xaa$_2$-Phe-Xaa$_4$-Phe-Ala-Glu-Gln- (SEQ ID NO:1303)
[linker]-Thr-Val-Gly-Trp-Val-<u>Glu</u>-Arg-His-Arg-<u>Lys</u>-Met-Leu-Arg-(OH)NH$_2$ e336) RNH-Lys-Xaa$_3$-Met-Gln-Val-Pro-Phe-Ser-Arg-Xaa$_1$-Xaa$_2$-Phe-Xaa$_4$-Phe-Ala-Glu-Gln- (SEQ ID NO:1304)
[linker]-Thr-Val-Gly-Trp-Val-<u>Glu</u>-Arg-His-Arg-<u>Lys</u>-Met-Leu-Arg-(OH)NH$_2$ e337) RNH-Lys-Ser-Xaa$_3$-Gln-Val-Pro-Phe-Ser-Arg-Xaa$_1$-Xaa$_2$-Phe-Xaa$_4$-Phe-Ala-Glu-Gln- (SEQ ID NO:1305)
[linker]-Thr-Val-Gly-Trp-Val-<u>Glu</u>-Arg-His-Arg-<u>Lys</u>-Met-Leu-Arg-(OH)NH$_2$ e338) RNH-Lys-Ser-Met-Xaa$_3$-Val-Pro-Phe-Ser-Arg-Xaa$_1$-Xaa$_2$-Phe-Xaa$_4$-Phe-Ala-Glu-Gln- (SEQ ID NO:1306)
[linker]-Thr-Val-Gly-Trp-Val-<u>Glu</u>-Arg-His-Arg-<u>Lys</u>-Met-Leu-Arg-(OH)NH$_2$ e339) RNH-Lys-Ser-Met-Gln-Xaa$_3$-Pro-Phe-Ser-Arg-Xaa$_1$-Xaa$_2$-Phe-Xaa$_4$-Phe-Ala-Glu-Gln- (SEQ ID NO:1307)
[linker]-Thr-Val-Gly-Trp-Val-<u>Glu</u>-Arg-His-Arg-<u>Lys</u>-Met-Leu-Arg-(OH)NH$_2$ e340) RNH-Lys-Ser-Met-Gln-Val-Xaa$_3$-Phe-Ser-Arg-Xaa$_1$-Xaa$_2$-Phe-Xaa$_4$-Phe-Ala-Glu-Gln- (SEQ ID NO:1308)
[linker]-Thr-Val-Gly-Trp-Val-<u>Glu</u>-Arg-His-Arg-<u>Lys</u>-Met-Leu-Arg-(OH)NH$_2$ e341) RNH-Lys-Ser-Met-Gln-Val-Pro-Xaa$_3$-Ser-Arg-Xaa$_1$-Xaa$_2$-Phe-Xaa$_4$-Phe-Ala-Glu-Gln- (SEQ ID NO:1309)
[linker]-Thr-Val-Gly-Trp-Val-<u>Glu</u>-Arg-His-Arg-<u>Lys</u>-Met-Leu-Arg-(OH)NH$_2$ e342) RNH-Lys-Ser-Met-Gln-Val-Pro-Phe-Xaa$_3$-Arg-Xaa$_1$-Xaa$_2$-Phe-Xaa$_4$-Phe-Ala-Glu-Gln- (SEQ ID NO:1310)
[linker]-Thr-Val-Gly-Trp-Val-<u>Glu</u>-Arg-His-Arg-<u>Lys</u>-Met-Leu-Arg-(OH)NH$_2$ e343) RNH-Lys-Ser-Met-Gln-Val-Pro-Phe-Ser-Xaa$_3$-Xaa$_1$-Xaa$_2$-Phe-Xaa$_4$-Phe-Ala-Glu-Gln- (SEQ ID NO:1311)
[linker]-Thr-Val-Gly-Trp-Val-<u>Glu</u>-Arg-His-Arg-<u>Lys</u>-Met-Leu-Arg-(OH)NH$_2$ e344) RNH-Lys-Ser-Met-Gln-Val-Pro-Phe-Ser-Arg-Cys-Cys-Phe-Ser-Xaa$_4$-Ala-Glu-Gln- (SEQ ID NO:1312)
[linker]-Thr-Val-Gly-Trp-Val-<u>Glu</u>-Arg-His-Arg-<u>Lys</u>-Met-Leu-Arg-(OH)NH$_2$ e345) RNH-Lys-Ser-Met-Gln-Val-Pro-Phe-Ser-Arg-Xaa$_1$-Xaa$_2$-Phe-Ser-Xaa$_4$-Ala-Glu-Gln- (SEQ ID NO:1313)
[linker]-Thr-Val-Gly-Trp-Val-<u>Glu</u>-Arg-His-Arg-<u>Lys</u>-Met-Leu-Arg-(OH)NH$_2$ e346) RNH-Xaa$_3$-Ser-Met-Gln-Val-Pro-Phe-Ser-Arg-Xaa$_1$-Xaa$_2$-Phe-Ser-Xaa$_4$-Ala-Glu-Gln- (SEQ ID NO:1314)
[linker]-Thr-Val-Gly-Trp-Val-<u>Glu</u>-Arg-His-Arg-<u>Lys</u>-Met-Leu-Arg-(OH)NH$_2$ e347) RNH-Lys-Xaa$_3$-Met-Gln-Val-Pro-Phe-Ser-Arg-Xaa$_1$-Xaa$_2$-Phe-Ser-Xaa$_4$-Ala-Glu-Gln- (SEQ ID NO:1315)
[linker]-Thr-Val-Gly-Trp-Val-<u>Glu</u>-Arg-His-Arg-<u>Lys</u>-Met-Leu-Arg-(OH)NH$_2$ e348) RNH-Lys-Ser-Xaa$_3$-Gln-Val-Pro-Phe-Ser-Arg-Xaa$_1$-Xaa$_2$-Phe-Ser-Xaa$_4$-Ala-Glu-Gln- (SEQ ID NO:1316)
[linker]-Thr-Val-Gly-Trp-Val-<u>Glu</u>-Arg-His-Arg-<u>Lys</u>-Met-Leu-Arg-(OH)NH$_2$ -continued e349) RNH-Lys-Ser-Met-Xaa$_3$-Val-Pro-Phe-Ser-Arg-Xaa$_1$-Xaa$_2$-Phe-Ser-Xaa$_4$-Ala-Glu-Gln- (SEQ ID NO:1317)
      [linker]-Thr-Val-Gly-Trp-Val-<u>Glu</u>-Arg-His-Arg-<u>Lys</u>-Met-Leu-Arg-(OH)NH$_2$ e350) RNH-Lys-Ser-Met-Gln-Xaa$_3$-Pro-Phe-Ser-Arg-Xaa$_1$-Xaa$_2$-Phe-Ser-Xaa$_4$-Ala-Glu-Gln- (SEQ ID NO:1318)
      [linker]-Thr-Val-Gly-Trp-Val-<u>Glu</u>-Arg-His-Arg-<u>Lys</u>-Met-Leu-Arg-(OH)NH$_2$ e351) RNH-Lys-Ser-Met-Gln-Val-Xaa$_3$-Phe-Ser-Arg-Xaa$_1$-Xaa$_2$-Phe-Ser-Xaa$_4$-Ala-Glu-Gln- (SEQ ID NO:1319)
      [linker]-Thr-Val-Gly-Trp-Val-<u>Glu</u>-Arg-His-Arg-<u>Lys</u>-Met-Leu-Arg-(OH)NH$_2$ e352) RNH-Lys-Ser-Met-Gln-Val-Pro-Xaa$_3$-Ser-Arg-Xaa$_1$-Xaa$_2$-Phe-Ser-Xaa$_4$-Ala-Glu-Gln- (SEQ ID NO:1320)
      [linker]-Thr-Val-Gly-Trp-Val-<u>Glu</u>-Arg-His-Arg-<u>Lys</u>-Met-Leu-Arg-(OH)NH$_2$ e353) RNH-Lys-Ser-Met-Gln-Val-Pro-Phe-Xaa$_3$-Arg-Xaa$_1$-Xaa$_2$-Phe-Ser-Xaa$_4$-Ala-Glu-Gln- (SEQ ID NO:1321)
      [linker]-Thr-Val-Gly-Trp-Val-<u>Glu</u>-Arg-His-Arg-<u>Lys</u>-Met-Leu-Arg-(OH)NH$_2$ e354) RNH-Lys-Ser-Met-Gln-Val-Pro-Phe-Ser-Xaa$_3$-Xaa$_1$-Xaa$_2$-Phe-Ser-Xaa$_4$-Ala-Glu-Gln- (SEQ ID NO:1322)
      [linker]-Thr-Val-Gly-Trp-Val-<u>Glu</u>-Arg-His-Arg-<u>Lys</u>-Met-Leu-Arg-(OH)NH$_2$ e355) RNH-Lys-Ser-Met-Gln-Val-Pro-Phe-Ser-Arg-Cys-Cys-Phe-Ser-Phe-Xaa$_4$-Glu-Gln- (SEQ ID NO:1323)
      [linker]-Thr-Val-Gly-Trp-Val-<u>Glu</u>-Arg-His-Arg-<u>Lys</u>-Met-Leu-Arg-(OH)NH$_2$ e356) RNH-Lys-Ser-Met-Gln-Val-Pro-Phe-Ser-Arg-Xaa$_1$-Xaa$_2$-Phe-Ser-Phe-Xaa$_4$-Glu-Gln- (SEQ ID NO:1324)
      [linker]-Thr-Val-Gly-Trp-Val-<u>Glu</u>-Arg-His-Arg-<u>Lys</u>-Met-Leu-Arg-(OH)NH$_2$ e357) RNH-Xaa$_3$-Ser-Met-Gln-Val-Pro-Phe-Ser-Arg-Xaa$_1$-Xaa$_2$-Phe-Ser-Phe-Xaa$_4$-Glu-Gln- (SEQ ID NO:1325)
      [linker]-Thr-Val-Gly-Trp-Val-<u>Glu</u>-Arg-His-Arg-<u>Lys</u>-Met-Leu-Arg-(OH)NH$_2$ e358) RNH-Lys-Xaa$_3$-Met-Gln-Val-Pro-Phe-Ser-Arg-Xaa$_1$-Xaa$_2$-Phe-Ser-Phe-Xaa$_4$-Glu-Gln- (SEQ ID NO:1326)
      [linker]-Thr-Val-Gly-Trp-Val-<u>Glu</u>-Arg-His-Arg-<u>Lys</u>-Met-Leu-Arg-(OH)NH$_2$ e359) RNH-Lys-Ser-Xaa$_3$-Gln-Val-Pro-Phe-Ser-Arg-Xaa$_1$-Xaa$_2$-Phe-Ser-Phe-Xaa$_4$-Glu-Gln- (SEQ ID NO:1327)
      [linker]-Thr-Val-Gly-Trp-Val-<u>Glu</u>-Arg-His-Arg-<u>Lys</u>-Met-Leu-Arg-(OH)NH$_2$ e360) RNH-Lys-Ser-Met-Xaa$_3$-Val-Pro-Phe-Ser-Arg-Xaa$_1$-Xaa$_2$-Phe-Ser-Phe-Xaa$_4$-Glu-Gln- (SEQ ID NO:1328)
      [linker]-Thr-Val-Gly-Trp-Val-<u>Glu</u>-Arg-His-Arg-<u>Lys</u>-Met-Leu-Arg-(OH)NH$_2$ e361) RNH-Lys-Ser-Met-Gln-Xaa$_3$-Pro-Phe-Ser-Arg-Xaa$_1$-Xaa$_2$-Phe-Ser-Phe-Xaa$_4$-Glu-Gln- (SEQ ID NO:1329)
      [linker]-Thr-Val-Gly-Trp-Val-<u>Glu</u>-Arg-His-Arg-<u>Lys</u>-Met-Leu-Arg-(OH)NH$_2$ e362) RNH-Lys-Ser-Met-Gln-Val-Xaa$_3$-Phe-Ser-Arg-Xaa$_1$-Xaa$_2$-Phe-Ser-Phe-Xaa$_4$-Glu-Gln- (SEQ ID NO:1330)
      [linker]-Thr-Val-Gly-Trp-Val-<u>Glu</u>-Arg-His-Arg-<u>Lys</u>-Met-Leu-Arg-(OH)NH$_2$ e363) RNH-Lys-Ser-Met-Gln-Val-Pro-Xaa$_3$-Ser-Arg-Xaa$_1$-Xaa$_2$-Phe-Ser-Phe-Xaa$_4$-Glu-Gln- (SEQ ID NO:1331)
      [linker]-Thr-Val-Gly-Trp-Val-<u>Glu</u>-Arg-His-Arg-<u>Lys</u>-Met-Leu-Arg-(OH)NH$_2$ e364) RNH-Lys-Ser-Met-Gln-Val-Pro-Phe-Xaa$_3$-Arg-Xaa$_1$-Xaa$_2$-Phe-Ser-Phe-Xaa$_4$-Glu-Gln- (SEQ ID NO:1332)
      [linker]-Thr-Val-Gly-Trp-Val-<u>Glu</u>-Arg-His-Arg-<u>Lys</u>-Met-Leu-Arg-(OH)NH$_2$ e365) RNH-Lys-Ser-Met-Gln-Val-Pro-Phe-Ser-Xaa$_3$-Xaa$_1$-Xaa$_2$-Phe-Ser-Phe-Xaa$_4$-Glu-Gln- (SEQ ID NO:1333)
      [linker]-Thr-Val-Gly-Trp-Val-<u>Glu</u>-Arg-His-Arg-<u>Lys</u>-Met-Leu-Arg-(OH)NH$_2$ e366) RNH-Lys-Ser-Met-Gln-Val-Pro-Phe-Ser-Arg-Cys-Cys-Phe-Ser-Phe-Ala-Xaa$_4$-Gln- (SEQ ID NO:1334)
      [linker]-Thr-Val-Gly-Trp-Val-<u>Glu</u>-Arg-His-Arg-<u>Lys</u>-Met-Leu-Arg-(OH)NH$_2$ e367) RNH-Lys-Ser-Met-Gln-Val-Pro-Phe-Ser-Arg-Xaa$_1$-Xaa$_2$-Phe-Ser-Phe-Ala-Xaa$_4$-Gln (SEQ ID NO:1335)
      [linker]-Thr-Val-Gly-Trp-Val-<u>Glu</u>-Arg-His-Arg-<u>Lys</u>-Met-Leu-Arg-(OH)NH$_2$ e368) RNH-Xaa$_3$-Ser-Met-Gln-Val-Pro-Phe-Ser-Arg-Xaa$_1$-Xaa$_2$-Phe-Ser-Phe-Ala-Xaa$_4$-Gln- (SEQ ID NO:1336)
      [linker]-Thr-Val-Gly-Trp-Val-<u>Glu</u>-Arg-His-Arg-<u>Lys</u>-Met-Leu-Arg-(OH)NH$_2$ e369) RNH-Lys-Xaa$_3$-Met-Gln-Val-Pro-Phe-Ser-Arg-Xaa$_1$-Xaa$_2$-Phe-Ser-Phe-Ala-Xaa$_4$-Gln- (SEQ ID NO:1337)
      [linker]-Thr-Val-Gly-Trp-Val-<u>Glu</u>-Arg-His-Arg-<u>Lys</u>-Met-Leu-Arg-(OH)NH$_2$ e370) RNH-Lys-Ser-Xaa$_3$-Gln-Val-Pro-Phe-Ser-Arg-Xaa$_1$-Xaa$_2$-Phe-Ser-Phe-Ala-Xaa$_4$-Gln- (SEQ ID NO:1338)
      [linker]-Thr-Val-Gly-Trp-Val-<u>Glu</u>-Arg-His-Arg-<u>Lys</u>-Met-Leu-Arg-(OH)NH$_2$ e371) RNH-Lys-Ser-Met-Xaa$_3$-Val-Pro-Phe-Ser-Arg-Xaa$_1$-Xaa$_2$-Phe-Ser-Phe-Ala-Xaa$_4$-Gln- (SEQ ID NO:1339)
      [linker]-Thr-Val-Gly-Trp-Val-<u>Glu</u>-Arg-His-Arg-<u>Lys</u>-Met-Leu-Arg-(OH)NH$_2$ e372) RNH-Lys-Ser-Met-Gln-Val-Pro-Phe-Ser-Arg-Cys-Cys-Phe-Ser-Phe-Ala-Glu-Xaa$_4$- (SEQ ID NO:1340)
      [linker]-Thr-Val-Gly-Trp-Val-<u>Glu</u>-Arg-His-Arg-<u>Lys</u>-Met-Leu-Arg-(OH)NH$_2$ e373) RNH-Lys-Ser-Met-Gln-Val-Pro-Phe-Ser-Arg-Xaa$_1$-Xaa$_2$-Phe-Ser-Phe-Ala-Glu-Xaa$_4$- (SEQ ID NO:1341)
      [linker]-Thr-Val-Gly-Trp-Val-<u>Glu</u>-Arg-His-Arg-<u>Lys</u>-Met-Leu-Arg-(OH)NH$_2$ e374) RNH-Xaa$_3$-Ser-Met-Gln-Val-Pro-Phe-Ser-Arg-Xaa$_1$-Xaa$_2$-Phe-Ser-Phe-Ala-Glu-Xaa$_4$- (SEQ ID NO:1342)
      [linker]-Thr-Val-Gly-Trp-Val-<u>Glu</u>-Arg-His-Arg-<u>Lys</u>-Met-Leu-Arg-(OH)NH$_2$ -continued

| e375) | RNH-Lys-Xaa₃-Met-Gln-Val-Pro-Phe-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1343) |
|---|---|---|
| e376) | RNH-Lys-Ser-Xaa₃-Gln-Val-Pro-Phe-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1344) |
| e377) | RNH-Lys-Ser-Met-Xaa₃-Val-Pro-Phe-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1345) |
| e378) | RNH-Lys-Ser-Met-Gln-Xaa₃-Pro-Phe-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1346) |
| e379) | RNH-Lys-Ser-Met-Gln-Val-Xaa₃-Phe-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1347) |
| e380) | RNH-Lys-Ser-Met-Gln-Val-Pro-Xaa₃-Ser-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1348) |
| e381) | RNH-Lys-Ser-Met-Gln-Val-Pro-Phe-Xaa₃-Arg-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1349) |
| e382) | RNH-Lys-Ser-Met-Gln-Val-Pro-Phe-Ser-Xaa₃-Xaa₁-Xaa₂-Phe-Ser-Phe-Ala-Glu-Xaa₄-[linker]-Thr-Val-Gly-Trp-Val-<u>Glu</u>-Arg-His-Arg-<u>Lys</u>-Met-Leu-Arg-(OH)NH₂ | (SEQ ID NO:1350) |

In the above structures:
R is selected from the group consisting of hydrogen, alkyl, alkenyl, alkylcarbonyl, arylcarbonyl, aryl, PEG (polyethylenglycol) and any other modifying group.
Xaa₃ is selected from the group consisting of L-Pro, P*, Btd and any L- or D-natural and non-natural amino acid.
Xaa₄ is selected from the group consisting of P*, Btd and any L- or D-natural amino acid and any non-natural amino acid.
P* is:

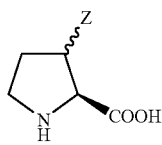

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, or Orn to Asp. Moieties other than naturally occurring amino acids may also be substituted, such as Btd:
Btd* is:

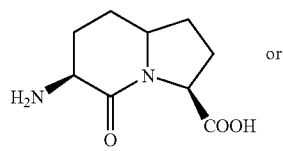

or

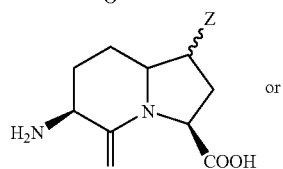

-continued

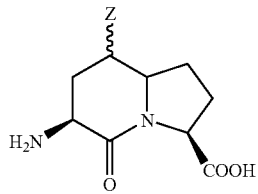

Z=hydrogen, alkyl, alkenyl, alkynyl, alkylcarbonyl, arylcarbonyl, aryl, aryl-hydroxy, and more Xaa₁ is selected from the group consisting of any L- or D-natural amino acid and any non-natural amino acid.

Xaa₂ is selected from the group consisting of any L- or D-natural amino acid and any non-natural amino acid.

The linker is a bifunctional group covalently attached to the N-terminal and C-terminal portions of the analog having the structure: H₂N-Z_A-COOH wherein Z_A is selected from the group consisting of: (1) alkyl, alkenyl, aralkyl, alkynyl; (2) —(CH₂)_n— wherein n is an integer n=9 to 14; (3) any combination of four natural amino acids or non-natural amino acids; and (4) -(Gly)₄- (SEQ ID NO: 1640).

MCP-1 Compounds:

Preferred embodiments of linear MCP-1 analogs of the present invention corresponding to a portion of the N-terminal and the internal region of MCP-1 having the following structures:

From the chemokine MCP-1 the following compounds:
Preferred embodiments of linear MCP-1 analogs of the present invention corresponding to a portion of the N-terminal and the internal region of MCP-1 having the following structures:

MCP-1-(1–35) acid or amide g2) RNH-Gln-Pro-Asp-Ala-Ile-Asn-Ala-Pro-Val-Thr-Cys-Cys-Tyr-Asn-Phe-Thr-Asn-Arg- (SEQ ID NO:1351)
Lys-Ile-Ser-Val-Gln-Arg-Leu-Ala-Ser-Tyr-Arg-Arg-Ile-Thr-Ser-Ser-Lys-(OH)NH$_2$ g3) RNH-Gln-Pro-Asp-Ala-Ile-Asn-Ala-Pro-Val-Thr-Xaa$_1$-Xaa$_2$-Tyr-Asn-Phe-Thr-Asn- (SEQ ID NO:1352)
Arg-Lys-Ile-Ser-Val-Gln-Arg-Leu-Ala-Ser-Tyr-Arg-Arg-Ile-Thr-Ser-Ser-Lys-(OH)NH$_2$ g4) RNH-Xaa$_3$-Pro-Asp-Ala-Ile-Asn-Ala-Pro-Val-Thr-Xaa$_1$-Xaa$_2$-Tyr-Asn-Phe-Thr-Asn- (SEQ ID NO:1353)
Arg-Lys-Ile-Ser-Val-Gln-Arg-Leu-Ala-Ser-Tyr-Arg-Arg-Ile-Thr-Ser-Ser-Lys-(OH)NH$_2$ g5) RNH-Gln-Xaa$_3$-Asp-Ala-Ile-Asn-Ala-Pro-Val-Thr-Xaa$_1$-Xaa$_2$-Tyr-Asn-Phe-Thr-Asn- (SEQ ID NO:1354)
Arg-Lys-Ile-Ser-Val-Gln-Arg-Leu-Ala-Ser-Tyr-Arg-Arg-Ile-Thr-Ser-Ser-Lys-(OH)NH$_2$ g6) RNH-Gln-Pro-Xaa$_3$-Ala-Ile-Asn-Ala-Pro-Val-Thr-Xaa$_1$-Xaa$_2$-Tyr-Asn-Phe-Thr-Asn- (SEQ ID NO:1355)
Arg-Lys-Ile-Ser-Val-Gln-Arg-Leu-Ala-Ser-Tyr-Arg-Arg-Ile-Thr-Ser-Ser-Lys-(OH)NH$_2$ g7) RNH-Gln-Pro-Asp-Xaa$_3$-Ile-Asn-Ala-Pro-Val-Thr-Xaa$_1$-Xaa$_2$-Tyr-Asn-Phe-Thr-Asn- (SEQ ID NO:1356)
Arg-Lys-Ile-Ser-Val-Gln-Arg-Leu-Ala-Ser-Tyr-Arg-Arg-Ile-Thr-Ser-Ser-Lys-(OH)NH$_2$ g8) RNH-Gln-Pro-Asp-Ala-Xaa$_3$-Asn-Ala-Pro-Val-Thr-Xaa$_1$-Xaa$_2$-Tyr-Asn-Phe-Thr-Asn- (SEQ ID NO:1357)
Arg-Lys-Ile-Ser-Val-Gln-Arg-Leu-Ala-Ser-Tyr-Arg-Arg-Ile-Thr-Ser-Ser-Lys-(OH)NH$_2$ g9) RNH-Gln-Pro-Asp-Ala-Ile-Xaa$_3$-Ala-Pro-Val-Thr-Xaa$_1$-Xaa$_2$-Tyr-Asn-Phe-Thr-Asn- (SEQ ID NO:1358)
Arg-Lys-Ile-Ser-Val-Gln-Arg-Leu-Ala-Ser-Tyr-Arg-Arg-Ile-Thr-Ser-Ser-Lys-(OH)NH$_2$ g10) RNH-Gln-Pro-Asp-Ala-Ile-Asn-Xaa$_3$-Pro-Val-Thr-Xaa$_1$-Xaa$_2$-Tyr-Asn-Phe-Thr-Asn- (SEQ ID NO:1359)
Arg-Lys-Ile-Ser-Val-Gln-Arg-Leu-Ala-Ser-Tyr-Arg-Arg-Ile-Thr-Ser-Ser-Lys-(OH)NH$_2$ g11) RNH-Gln-Pro-Asp-Ala-Ile-Asn-Ala-Xaa$_3$-Val-Thr-Xaa$_1$-Xaa$_2$-Tyr-Asn-Phe-Thr-Asn- (SEQ ID NO:1360)
Arg-Lys-Ile-Ser-Val-Gln-Arg-Leu-Ala-Ser-Tyr-Arg-Arg-Ile-Thr-Ser-Ser-Lys-(OH)NH$_2$ g12) RNH-Gln-Pro-Asp-Ala-Ile-Asn-Ala-Pro-Xaa$_3$-Thr-Xaa$_1$-Xaa$_2$-Tyr-Asn-Phe-Thr-Asn- (SEQ ID NO:1361)
Arg-Lys-Ile-Ser-Val-Gln-Arg-Leu-Ala-Ser-Tyr-Arg-Arg-Ile-Thr-Ser-Ser-Lys-(OH)NH$_2$ g13) RNH-Gln-Pro-Asp-Ala-Ile-Asn-Ala-Pro-Val-Xaa$_3$-Xaa$_1$-Xaa$_2$-Tyr-Asn-Phe-Thr-Asn- (SEQ ID NO:1362)
Arg-Lys-Ile-Ser-Val-Gln-Arg-Leu-Ala-Ser-Tyr-Arg-Arg-Ile-Thr-Ser-Ser-Lys-(OH)NH$_2$

[Glu$^{13}$]-MCP-1-(1–35) acid or amide g14) RNH-Gln-Pro-Asp-Ala-Ile-Asn-Ala-Pro-Val-Thr-Cys-Cys-Glu-Asn-Phe-Thr-Asn-Arg- (SEQ ID NO:1363)
Lys-Ile-Ser-Val-Gln-Arg-Leu-Ala-Ser-Tyr-Arg-Arg-Ile-Thr-Ser-Ser-Lys-(OH)NH$_2$ g15) RNH-Gln-Pro-Asp-Ala-Ile-Asn-Ala-Pro-Val-Thr-Xaa$_1$-Xaa$_2$-Glu-Asn-Phe-Thr-Asn- (SEQ ID NO:1364)
Arg-Lys-Ile-Ser-Val-Gln-Arg-Leu-Ala-Ser-Tyr-Arg-Arg-Ile-Thr-Ser-Ser-Lys-(OH)NH$_2$ g16) RNH-Xaa$_3$-Pro-Asp-Ala-Ile-Asn-Ala-Pro-Val-Thr-Xaa$_1$-Xaa$_2$-Glu-Asn-Phe-Thr-Asn- (SEQ ID NO:1365)
Arg-Lys-Ile-Ser-Val-Gln-Arg-Leu-Ala-Ser-Tyr-Arg-Arg-Ile-Thr-Ser-Ser-Lys-(OH)NH$_2$ g17) RNH-Gln-Xaa$_3$-Asp-Ala-Ile-Asn-Ala-Pro-Val-Thr-Xaa$_1$-Xaa$_2$-Glu-Asn-Phe-Thr-Asn- (SEQ ID NO:1366)
Arg-Lys-Ile-Ser-Val-Gln-Arg-Leu-Ala-Ser-Tyr-Arg-Arg-Ile-Thr-Ser-Ser-Lys-(OH)NH$_2$ g18) RNH-Gln-Pro-Xaa$_3$-Ala-Ile-Asn-Ala-Pro-Val-Thr-Xaa$_1$-Xaa$_2$-Glu-Asn-Phe-Thr-Asn- (SEQ ID NO:1367)
Arg-Lys-Ile-Ser-Val-Gln-Arg-Leu-Ala-Ser-Tyr-Arg-Arg-Ile-Thr-Ser-Ser-Lys-(OH)NH$_2$ g19) RNH-Gln-Pro-Asp-Xaa$_3$-Ile-Asn-Ala-Pro-Val-Thr-Xaa$_1$-Xaa$_2$-Glu-Asn-Phe-Thr-Asn- (SEQ ID NO:1368)
Arg-Lys-Ile-Ser-Val-Gln-Arg-Leu-Ala-Ser-Tyr-Arg-Arg-Ile-Thr-Ser-Ser-Lys-(OH)NH$_2$ g20) RNH-Gln-Pro-Asp-Ala-Xaa$_3$-Asn-Ala-Pro-Val-Thr-Xaa$_1$-Xaa$_2$-Glu-Asn-Phe-Thr-Asn- (SEQ ID NO:1369)
Arg-Lys-Ile-Ser-Val-Gln-Arg-Leu-Ala-Ser-Tyr-Arg-Arg-Ile-Thr-Ser-Ser-Lys-(OH)NH$_2$ g21) RNH-Gln-Pro-Asp-Ala-Ile-Xaa$_3$-Ala-Pro-Val-Thr-Xaa$_1$-Xaa$_2$-Glu-Asn-Phe-Thr-Asn- (SEQ ID NO:1370)
Arg-Lys-Ile-Ser-Val-Gln-Arg-Leu-Ala-Ser-Tyr-Arg-Arg-Ile-Thr-Ser-Ser-Lys-(OH)NH$_2$ g22) RNH-Gln-Pro-Asp-Ala-Ile-Asn-Xaa$_3$-Pro-Val-Thr-Xaa$_1$-Xaa$_2$-Glu-Asn-Phe-Thr-Asn- (SEQ ID NO:1371)
Arg-Lys-Ile-Ser-Val-Gln-Arg-Leu-Ala-Ser-Tyr-Arg-Arg-Ile-Thr-Ser-Ser-Lys-(OH)NH$_2$ g23) RNH-Gln-Pro-Asp-Ala-Ile-Asn-Ala-Xaa$_3$-Val-Thr-Xaa$_1$-Xaa$_2$-Glu-Asn-Phe-Thr-Asn- (SEQ ID NO:1372)
Arg-Lys-Ile-Ser-Val-Gln-Arg-Leu-Ala-Ser-Tyr-Arg-Arg-Ile-Thr-Ser-Ser-Lys-(OH)NH$_2$ g24) RNH-Gln-Pro-Asp-Ala-Ile-Asn-Ala-Pro-Xaa$_3$-Thr-Xaa$_1$-Xaa$_2$-Glu-Asn-Phe-Thr-Asn- (SEQ ID NO:1373)
Arg-Lys-Ile-Ser-Val-Gln-Arg-Leu-Ala-Ser-Tyr-Arg-Arg-Ile-Thr-Ser-Ser-Lys-(OH)NH$_2$ g25) RNH-Gln-Pro-Asp-Ala-Ile-Asn-Ala-Pro-Val-Xaa$_3$-Xaa$_1$-Xaa$_2$-Glu-Asn-Phe-Thr-Asn- (SEQ ID NO:1374)
Arg-Lys-Ile-Ser-Val-Gln-Arg-Leu-Ala-Ser-Tyr-Arg-Arg-Ile-Thr-Ser-Ser-Lys-(OH)NH$_2$ Preferred embodiments of linear MCP-1 analogs of the present invention corresponding to a portion of the internal region of MCP-1 having the following structures:

MCP-1-(12—36) acid or amide
g26)   RNH-Ala-Lys-Xaa$_4$-Asn-Phe-Thr-Asn-Arg-Lys-Ile-Ser-Val-Gln-Arg-Leu-Ala-Ser-Tyr-   (SEQ ID NO:1375)
       Arg-Arg-Ile-Thr-Ser-Ser-Lys-Glu-(OH)NH$_2$ MCP-1-(37—51) acid or amide
g27)   RNH-Pro-Lys-Glu-Ala-Val-Ile-Phe-Lys-Thr-Ile-Val-Ala-Lys-Glu-Ile-(OH)NH$_2$   (SEQ ID NO:1376)

Preferred embodiments of linear MCP-1 analogs of the present invention corresponding to a portion of the C-terminal region of MCP-1 having the following structures:

MCP-1-(53—76) acid or amide
g28)   RNH-Ala-Asp-Pro-Lys-Gln-Lys-Trp-Val-Gln-Asp-Ser-Met-Asp-His-Leu-Asp-Lys-Gln-   (SEQ ID NO:1377)
       Thr-(OH)NH$_2$ Preferred embodiments of linear MCP-1 analogs of the present invention corresponding to a portion the N-terminal region joined with a linker to the C-terminal region of MCP-1 having the following structures:

MCP-1-(13—35)-[linker]-MCP-1-(58—76) acid or amide
g29)   RNH-Tyr-Asn-Phe-Thr-Asn-Arg-Lys-Ile-Ser-Val-Gln-Arg-Leu-Ala-Ser-Tyr-Arg-Arg-   (SEQ ID NO:1378)
       Ile-Thr-Ser-Ser-Lys-[linker]-Lys-Trp-Val-Gln-Asp-Ser-Met-Asp-His-Leu-Asp-Lys-
       Gln-Thr-(OH)NH$_2$ MCP-1-(1—14)-[linker]-MCP-1-(58—76) acid or amide
g30)   RNH-Gln-Pro-Asp-Ala-Ile-Asn-Ala-Pro-Val-Thr-Cys-Cys-Tyr-Asn-[linker]-Lys-Trp-   (SEQ ID NO:1379)
       Val-Gln-Asp-Ser-Met-Asp-His-Leu-Asp-Lys-Gln-Thr-(OH)NH$_2$ g31)   RNH-Gln-Pro-Asp-Ala-Ile-Asn-Ala-Pro-Val-Thr-Xaa$_1$-Xaa$_2$-Tyr-Asn-[linker]-Lys-   (SEQ ID NO:1380)
       Trp-Val-Gln-Asp-Ser-Met-Asp-His-Leu-Asp-Lys-Gln-Thr-(OH)NH$_2$ MCP-1-(1—14)-[linker]-MCP-1-(58—76) acid or amide
g32)   RNH-Xaa$_3$-Pro-Asp-Ala-Ile-Asn-Ala-Pro-Val-Thr-Xaa$_1$-Xaa$_2$-Tyr-Asn-[linker]-Lys-   (SEQ ID NO:1381)
       Trp-Val-Gln-Asp-Ser-Met-Asp-His-Leu-Asp-Lys-Gln-Thr-(OH)NH$_2$ g33)   RNH-Gln-Xaa$_3$-Asp-Ala-Ile-Asn-Ala-Pro-Val-Thr-Xaa$_1$-Xaa$_2$-Tyr-Asn-[linker]-Lys-   (SEQ ID NO:1382)
       Trp-Val-Gln-Asp-Ser-Met-Asp-His-Leu-Asp-Lys-Gln-Thr-(OH)NH$_2$ g34)   RNH-Gln-Pro-Xaa$_3$-Ala-Ile-Asn-Ala-Pro-Val-Thr-Xaa$_1$-Xaa$_2$-Tyr-Asn-[linker]-Lys-   (SEQ ID NO:1383)
       Trp-Val-Gln-Asp-Ser-Met-Asp-His-Leu-Asp-Lys-Gln-Thr-(OH)NH$_2$ g35)   RNH-Gln-Pro-Asp-Xaa$_3$-Ile-Asn-Ala-Pro-Val-Thr-Xaa$_1$-Xaa$_2$-Tyr-Asn-[linker]-Lys-   (SEQ ID NO:1384)
       Trp-Val-Gln-Asp-Ser-Met-Asp-His-Leu-Asp-Lys-Gln-Thr-(OH)NH$_2$ g36)   RNH-Gln-Pro-Asp-Ala-Xaa$_3$-Asn-Ala-Pro-Val-Thr-Xaa$_1$-Xaa$_2$-Tyr-Asn-[linker]-Lys-   (SEQ ID NO:1385)
       Trp-Val-Gln-Asp-Ser-Met-Asp-His-Leu-Asp-Lys-Gln-Thr-(OH)NH$_2$ g37)   RNH-Gln-Pro-Asp-Ala-Ile-Xaa$_3$-Ala-Pro-Val-Thr-Xaa$_1$-Xaa$_2$-Tyr-Asn-[linker]-Lys-   (SEQ ID NO:1386)
       Trp-Val-Gln-Asp-Ser-Met-Asp-His-Leu-Asp-Lys-Gln-Thr-(OH)NH$_2$ g38)   RNH-Gln-Pro-Asp-Ala-Ile-Asn-Xaa$_3$-Pro-Val-Thr-Xaa$_1$-Xaa$_2$-Tyr-Asn-[linker]-Lys-   (SEQ ID NO:1387)
       Trp-Val-Gln-Asp-Ser-Met-Asp-His-Leu-Asp-Lys-Gln-Thr-(OH)NH$_2$ g39)   RNH-Gln-Pro-Asp-Ala-Ile-Asn-Ala-Xaa$_3$-Val-Thr-Xaa$_1$-Xaa$_2$-Tyr-Asn-[linker]-Lys-   (SEQ ID NO:1388)
       Trp-Val-Gln-Asp-Ser-Met-Asp-His-Leu-Asp-Lys-Gln-Thr-(OH)NH$_2$ g40)   RNH-Gln-Pro-Asp-Ala-Ile-Asn-Ala-Pro-Xaa$_3$-Thr-Xaa$_1$-Xaa$_2$-Tyr-Asn-[linker]-Lys-   (SEQ ID NO:1389)
       Trp-Val-Gln-Asp-Ser-Met-Asp-His-Leu-Asp-Lys-Gln-Thr-(OH)NH$_2$ g41)   RNH-Gln-Pro-Asp-Ala-Ile-Asn-Ala-Pro-Val-Xaa$_3$-Xaa$_1$-Xaa$_2$-Tyr-Asn-[linker]-Lys-   (SEQ ID NO:1390)
       Trp-Val-Gln-Asp-Ser-Met-Asp-His-Leu-Asp-Lys-Gln-Thr-(OH)NH$_2$ g42)   RNH-Xaa$_3$-Pro-Asp-Ala-Ile-Asn-Ala-Pro-Val-Thr-Xaa$_1$-Xaa$_2$-Xaa$_4$-Asn-[linker]-Lys-   (SEQ ID NO:1391)
       Trp-Val-Gln-Asp-Ser-Met-Asp-His-Leu-Asp-Lys-Gln-Thr-(OH)NH$_2$ -continued g43) RNH-Gln-Xaa₃-Asp-Ala-Ile-Asn-Ala-Pro-Val-Thr-Xaa₁-Xaa₂-Xaa₄-Asn-[linker]-Lys- (SEQ ID NO:1392)
Trp-Val-Gln-Asp-Ser-Met-Asp-His-Leu-Asp-Lys-Gln-Thr-(OH)NH₂ g44) RNH-Gln-Pro-Xaa₃-Ala-Ile-Asn-Ala-Pro-Val-Thr-Xaa₁-Xaa₂-Xaa₄-Asn-[linker]-Lys- (SEQ ID NO:1393)
Trp-Val-Gln-Asp-Ser-Met-Asp-His-Leu-Asp-Lys-Gln-Thr-(OH)NH₂ g45) RNH-Gln-Pro-Asp-Xaa₃-Ile-Asn-Ala-Pro-Val-Thr-Xaa₁-Xaa₂-Xaa₄-Asn-[linker]-Lys- (SEQ ID NO:1394)
Trp-Val-Gln-Asp-Ser-Met-Asp-His-Leu-Asp-Lys-Gln-Thr-(OH)NH₂ g46) RNH-Gln-Pro-Asp-Ala-Xaa₃-Asn-Ala-Pro-Val-Thr-Xaa₁-Xaa₂-Xaa₄-Asn-[linker]-Lys- (SEQ ID NO:1395)
Trp-Val-Gln-Asp-Ser-Met-Asp-His-Leu-Asp-Lys-Gln-Thr-(OH)NH₂ g47) RNH-Gln-Pro-Asp-Ala-Ile-Xaa₃-Ala-Pro-Val-Thr-Xaa₁-Xaa₂-Xaa₄-Asn-[linker]-Lys- (SEQ ID NO:1396)
Trp-Val-Gln-Asp-Ser-Met-Asp-His-Leu-Asp-Lys-Gln-Thr-(OH)NH₂ g48) RNH-Gln-Pro-Asp-Ala-Ile-Asn-Xaa₃-Pro-Val-Thr-Xaa₁-Xaa₂-Xaa₄-Asn-[linker]-Lys- (SEQ ID NO:1397)
Trp-Val-Gln-Asp-Ser-Met-Asp-His-Leu-Asp-Lys-Gln-Thr-(OH)NH₂ g49) RNH-Gln-Pro-Asp-Ala-Ile-Asn-Ala-Xaa₃-Val-Thr-Xaa₁-Xaa₂-Xaa₄-Asn-[linker]-Lys- (SEQ ID NO:1398)
Trp-Val-Gln-Asp-Ser-Met-Asp-His-Leu-Asp-Lys-Gln-Thr-(OH)NH₂ g50) RNH-Gln-Pro-Asp-Ala-Ile-Asn-Ala-Pro-Xaa₃-Thr-Xaa₁-Xaa₂-Xaa₄-Asn-[linker]-Lys- (SEQ ID NO:1399)
Trp-Val-Gln-Asp-Ser-Met-Asp-His-Leu-Asp-Lys-Gln-Thr-(OH)NH₂ g51) RNH-Gln-Pro-Asp-Ala-Ile-Asn-Ala-Pro-Val-Xaa₃-Xaa₁-Xaa₂-Xaa₄-Asn-[linker]-Lys- (SEQ ID NO:1400)
Trp-Val-Gln-Asp-Ser-Met-Asp-His-Leu-Asp-Lys-Gln-Thr-(OH)NH₂ g52) RNH-Xaa₃-Pro-Asp-Ala-Ile-Asn-Ala-Pro-Val-Thr-Xaa₁-Xaa₂-Tyr-Xaa₄-[linker]-Lys- (SEQ ID NO:1401)
Trp-Val-Gln-Asp-Ser-Met-Asp-His-Leu-Asp-Lys-Gln-Thr-(OH)NH₂ g53) RNH-Gln-Xaa₃-Asp-Ala-Ile-Asn-Ala-Pro-Val-Thr-Xaa₁-Xaa₂-Tyr-Xaa₄-[linker]-Lys- (SEQ ID NO:1402)
Trp-Val-Gln-Asp-Ser-Met-Asp-His-Leu-Asp-Lys-Gln-Thr-(OH)NH₂ g54) RNH-Gln-Pro-Xaa₃-Ala-Ile-Asn-Ala-Pro-Val-Thr-Xaa₁-Xaa₂-Tyr-Xaa₄-[linker]-Lys- (SEQ ID NO:1403)
Trp-Val-Gln-Asp-Ser-Met-Asp-His-Leu-Asp-Lys-Gln-Thr-(OH)NH₂ g55) RNH-Gln-Pro-Asp-Xaa₃-Ile-Asn-Ala-Pro-Val-Thr-Xaa₁-Xaa₂-Tyr-Xaa₄-[linker]-Lys- (SEQ ID NO:1404)
Trp-Val-Gln-Asp-Ser-Met-Asp-His-Leu-Asp-Lys-Gln-Thr-(OH)NH₂ g56) RNH-Gln-Pro-Asp-Ala-Xaa₃-Asn-Ala-Pro-Val-Thr-Xaa₁-Xaa₂-Tyr-Xaa₄-[linker]-Lys- (SEQ ID NO:1405)
Trp-Val-Gln-Asp-Ser-Met-Asp-His-Leu-Asp-Lys-Gln-Thr-(OH)NH₂ g57) RNH-Gln-Pro-Asp-Ala-Ile-Xaa₃-Ala-Pro-Val-Thr-Xaa₁-Xaa₂-Tyr-Xaa₄-[linker]-Lys- (SEQ ID NO:1406)
Trp-Val-Gln-Asp-Ser-Met-Asp-His-Leu-Asp-Lys-Gln-Thr-(OH)NH₂ g58) RNH-Gln-Pro-Asp-Ala-Ile-Asn-Xaa₃-Pro-Val-Thr-Xaa₁-Xaa₂-Tyr-Xaa₄-[linker]-Lys- (SEQ ID NO:1407)
Trp-Val-Gln-Asp-Ser-Met-Asp-His-Leu-Asp-Lys-Gln-Thr-(OH)NH₂ g59) RNH-Gln-Pro-Asp-Ala-Ile-Asn-Ala-Xaa₃-Val-Thr-Xaa₁-Xaa₂-Tyr-Xaa₄-[linker]-Lys- (SEQ ID NO:1408)
Trp-Val-Gln-Asp-Ser-Met-Asp-His-Leu-Asp-Lys-Gln-Thr-(OH)NH₂ g60) RNH-Gln-Pro-Asp-Ala-Ile-Asn-Ala-Pro-Xaa₃-Thr-Xaa₁-Xaa₂-Tyr-Xaa₄-[linker]-Lys- (SEQ ID NO:1409)
Trp-Val-Gln-Asp-Ser-Met-Asp-His-Leu-Asp-Lys-Gln-Thr-(OH)NH₂ g61) RNH-Gln-Pro-Asp-Ala-Ile-Asn-Ala-Pro-Val-Xaa₃-Xaa₁-Xaa₂-Tyr-Xaa₄-[linker]-Lys- (SEQ ID NO:1410)
Trp-Val-Gln-Asp-Ser-Met-Asp-His-Leu-Asp-Lys-Gln-Thr-(OH)NH₂

Preferred embodiments of cyclic MCP-1 analogs of the present invention corresponding to a cyclic portion of the N-terminal and the internal region of MCP-1 having the following structures:

[Ala$^{11}$, Lys$^{12}$, Glu$^{36}$]-MCP-1-(11–36) cyclic(Lys12–Glu36) acid or amide
g62) RNH-Ala-Lys-Xaa₃-Asn-Phe-Thr-Asn-Arg-Lys-Ile-Ser-Val-Gln-Arg-Leu-Ala-Ser-Tyr- (SEQ ID NO:1411)
Arg-Arg-Ile-Thr-Ser-Ser-Lys-Glu-(OH)NH₂

[Ala$^{11}$, Lys$^{12}$, Glu$^{36}$]-MCP-1-(11–36) cyclic(Lys19–Glu36) acid or amide
g63) RNH-Ala-Lys-Xaa₃-Asn-Phe-Thr-Asn-Arg-Lys-Ile-Ser-Val-Gln-Arg-Leu-Ala-Ser-Tyr- (SEQ ID NO:1412)
Arg-Arg-Ile-Thr-Ser-Ser-Lys-Glu-(OH)NH₂

[Glu$^{13}$]-MCP-1-(1–35) cyclic(Glu13–Lys19) acid or amide
g64) RNH-Gln-Pro-Asp-Ala-Ile-Asn-Ala-Pro-Val-Thr-Xaa₁-Xaa₂-Glu-Asn-Phe-Thr-Asn- (SEQ ID NO:1413)
Arg-Lys-Ile-Ser-Val-Gln-Arg-Leu-Ala-Ser-Tyr-Arg-Arg-Ile-Thr-Ser-Ser-Lys-(OH)NH₂

Preferred embodiments of cyclic MCP-1 analogs of the present invention corresponding to a portion the N-terminal region joined with a linker to a cyclic portion of the C-terminal region of MCP-1 having the following structures:

```
MCP-1-(1-14)-[linker]-MCP-1-(58-76) cyclic(Asp65-Lys74) acid or amide g65)    RNH-Gln-Pro-Asp-Ala-Ile-Asn-Ala-Pro-Val-Thr-Cys-Cys-Tyr-Asn-[linker]-Lys-Trp-        (SEQ ID NO:1414)
        Val-Gln-Asp-Ser-Met-Asp-His-Leu-Asp-Lys-Gln-Thr-(OH)NH2 g66)    RNH-Gln-Pro-Asp-Ala-Ile-Asn-Ala-Pro-Val-Thr-Xaa1-Xaa2-Tyr-Asn-[linker]-Lys-          (SEQ ID NO:1415)
        Trp-Val-Gln-Asp-Ser-Met-Asp-His-Leu-Asp-Lys-Gln-Thr-(OH)NH2

MCP-1-(13-35)-[linker]-MCP-1-(58-76) cyclic(Asp65-Lys74) acid or amide g67)    RNH-Tyr-Asn-Phe-Thr-Asn-Arg-Lys-Ile-Ser-Val-Gln-Arg-Leu-Ala-Ser-Tyr-Arg-Arg-         (SEQ ID NO:1416)
        Ile-Thr-Ser-Ser-Lys-[linker]-Lys-Trp-Val-Gln-Asp-Ser-Met-Asp-His-Leu-Asp-Lys-
        Gln-Thr-(OH)NH2

MCP-1-(1-14)-[linker]-MCP-1-(58-76) cyclic(D65-K74) acid or amide g68)    RNH-Xaa3-Pro-Asp-Ala-Ile-Asn-Ala-Pro-Val-Thr-Xaa1-Xaa2-Tyr-Asn-[linker]-Lys-         (SEQ ID NO:1417)
        Trp-Val-Gln-Asp-Ser-Met-Asp-His-Leu-Asp-Lys-Gln-Thr-(OH)NH2 g69)    RNH-Gln-Xaa3-Asp-Ala-Ile-Asn-Ala-Pro-Val-Thr-Xaa1-Xaa2-Tyr-Asn-[linker]-Lys-         (SEQ ID NO:1418)
        Trp-Val-Gln-Asp-Ser-Met-Asp-His-Leu-Asp-Lys-Gln-Thr-(OH)NH2 g70)    RNH-Gln-Pro-Xaa3-Ala-Ile-Asn-Ala-Pro-Val-Thr-Xaa1-Xaa2-Tyr-Asn-[linker]-Lys-         (SEQ ID NO:1419)
        Trp-Val-Gln-Asp-Ser-Met-Asp-His-Leu-Asp-Lys-Gln-Thr-(OH)NH2 g71)    RNH-Gln-Pro-Asp-Xaa3-Ile-Asn-Ala-Pro-Val-Thr-Xaa1-Xaa2-Tyr-Asn-[linker]-Lys-         (SEQ ID NO:1420)
        Trp-Val-Gln-Asp-Ser-Met-Asp-His-Leu-Asp-Lys-Gln-Thr-(OH)NH2 g72)    RNH-Gln-Pro-Asp-Ala-Xaa3-Asn-Ala-Pro-Val-Thr-Xaa1-Xaa2-Tyr-Asn-[linker]-Lys-         (SEQ ID NO:1421)
        Trp-Val-Gln-Asp-Ser-Met-Asp-His-Leu-Asp-Lys-Gln-Thr-(OH)NH2 g73)    RNH-Gln-Pro-Asp-Ala-Ile-Xaa3-Ala-Pro-Val-Thr-Xaa1-Xaa2-Tyr-Asn-[linker]-Lys-         (SEQ ID NO:1422)
        Trp-Val-Gln-Asp-Ser-Met-Asp-His-Leu-Asp-Lys-Gln-Thr-(OH)NH2 g74)    RNH-Gln-Pro-Asp-Ala-Ile-Asn-Xaa3-Pro-Val-Thr-Xaa1-Xaa2-Tyr-Asn-[linker]-Lys-         (SEQ ID NO:1423)
        Trp-Val-Gln-Asp-Ser-Met-Asp-His-Leu-Asp-Lys-Gln-Thr-(OH)NH2 g75)    RNH-Gln-Pro-Asp-Ala-Ile-Asn-Ala-Xaa3-Val-Thr-Xaa1-Xaa2-Tyr-Asn-[linker]-Lys-         (SEQ ID NO:1424)
        Trp-Val-Gln-Asp-Ser-Met-Asp-His-Leu-Asp-Lys-Gln-Thr-(OH)NH2 g76)    RNH-Gln-Pro-Asp-Ala-Ile-Asn-Ala-Pro-Xaa3-Thr-Xaa1-Xaa2-Tyr-Asn-[linker]-Lys-         (SEQ ID NO:1425)
        Trp-Val-Gln-Asp-Ser-Met-Asp-His-Leu-Asp-Lys-Gln-Thr-(OH)NH2 g77)    RNH-Gln-Pro-Asp-Ala-Ile-Asn-Ala-Pro-Val-Xaa3-Xaa1-Xaa2-Tyr-Asn-[linker]-Lys-         (SEQ ID NO:1426)
        Trp-Val-Gln-Asp-Ser-Met-Asp-His-Leu-Asp-Lys-Gln-Thr-(OH)NH2 g78)    RNH-Xaa3-Pro-Asp-Ala-Ile-Asn-Ala-Pro-Val-Thr-Xaa1-Xaa2-Xaa4-Asn-[linker]-Lys-        (SEQ ID NO:1427)
        Trp-Val-Gln-Asp-Ser-Met-Asp-His-Leu-Asp-Lys-Gln-Thr-(OH)NH2 g79)    RNH-Gln-Xaa3-Asp-Ala-Ile-Asn-Ala-Pro-Val-Thr-Xaa1-Xaa2-Xaa4-Asn-[linker]-Lys-        (SEQ ID NO:1428)
        Trp-Val-Gln-Asp-Ser-Met-Asp-His-Leu-Asp-Lys-Gln-Thr(OH)NH2 g80)    RNH-Gln-Pro-Xaa3-Ala-Ile-Asn-Ala-Pro-Val-Thr-Xaa1-Xaa2-Xaa4-Asn-[linker]-Lys-        (SEQ ID NO:1429)
        Trp-Val-Gln-Asp-Ser-Met-Asp-His-Leu-Asp-Lys-Gln-Thr-(OH)NH2
```

-continued g81) RNH-Gln-Pro-Asp-Xaa$_3$-Ile-Asn-Ala-Pro-Val-Thr-Xaa$_1$-Xaa$_2$-Xaa$_4$-Asn-[linker]-Lys- (SEQ ID NO:1430)
Trp-Val-Gln-Asp-Ser-Met-<u>Asp</u>-His-Leu-Asp-<u>Lys</u>-Gln-Thr-(OH)NH$_2$ g82) RNH-Gln-Pro-Asp-Ala-Xaa$_3$-Asn-Ala-Pro-Val-Thr-Xaa$_1$-Xaa$_2$-Xaa$_4$-Asn-[linker]-Lys- (SEQ ID NO:1431)
Trp-Val-Gln-Asp-Ser-Met-<u>Asp</u>-His-Leu-Asp-<u>Lys</u>-Gln-Thr-(OH)NH$_2$ g83) RNH-Gln-Pro-Asp-Ala-Ile-Xaa$_3$-Ala-Pro-Val-Thr-Xaa$_1$-Xaa$_2$-Xaa$_4$-Asn-[linker]-Lys- (SEQ ID NO:1432)
Trp-Val-Gln-Asp-Ser-Met-<u>Asp</u>-His-Leu-Asp-<u>Lys</u>-Gln-Thr-(OH)NH$_2$ g84) RNH-Gln-Pro-Asp-Ala-Ile-Asn-Xaa$_3$-Pro-Val-Thr-Xaa$_1$-Xaa$_2$-Xaa$_4$-Asn-[linker]-Lys- (SEQ ID NO:1433)
Trp-Val-Gln-Asp-Ser-Met-<u>Asp</u>-His-Leu-Asp-<u>Lys</u>-Gln-Thr-(OH)NH$_2$ g85) RNH-Gln-Pro-Asp-Ala-Ile-Asn-Ala-Xaa$_3$-Val-Thr-Xaa$_1$-Xaa$_2$-Xaa$_4$-Asn-[linker]-Lys- (SEQ ID NO:1434)
Trp-Val-Gln-Asp-Ser-Met-<u>Asp</u>-His-Leu-Asp-<u>Lys</u>-Gln-Thr-(OH)NH$_2$ g86) RNH-Gln-Pro-Asp-Ala-Ile-Asn-Ala-Pro-Xaa$_3$-Thr-Xaa$_1$-Xaa$_2$-Xaa$_4$-Asn-[linker]-Lys- (SEQ ID NO:1435)
Trp-Val-Gln-Asp-Ser-Met-<u>Asp</u>-His-Leu-Asp-<u>Lys</u>-Gln-Thr-(OH)NH$_2$ g87) RNH-Gln-Pro-Asp-Ala-Ile-Asn-Ala-Pro-Val-Xaa$_3$-Xaa$_1$-Xaa$_2$-Xaa$_4$-Asn-[linker]-Lys- (SEQ ID NO:1436)
Trp-Val-Gln-Asp-Ser-Met-<u>Asp</u>-His-Leu-Asp-<u>Lys</u>-Gln-Thr-(OH)NH$_2$ g88) RNH-Xaa$_3$-Pro-Asp-Ala-Ile-Asn-Ala-Pro-Val-Thr-Xaa$_1$-Xaa$_2$-Tyr-Xaa$_4$-[linker]-Lys- (SEQ ID NO:1437)
Trp-Val-Gln-Asp-Ser-Met-<u>Asp</u>-His-Leu-Asp-<u>Lys</u>-Gln-Thr-(OH)NH$_2$ g89) RNH-Gln-Xaa$_3$-Asp-Ala-Ile-Asn-Ala-Pro-Val-Thr-Xaa$_1$-Xaa$_2$-Tyr-Xaa$_4$-[linker]-Lys- (SEQ ID NO:1438)
Trp-Val-Gln-Asp-Ser-Met-<u>Asp</u>-His-Leu-Asp-<u>Lys</u>-Gln-Thr-(OH)NH$_2$ g90) RNH-Gln-Pro-Xaa$_3$-Ala-Ile-Asn-Ala-Pro-Val-Thr-Xaa$_1$-Xaa$_2$-Tyr-Xaa$_4$-[linker]-Lys- (SEQ ID NO:1439)
Trp-Val-Gln-Asp-Ser-Met-<u>Asp</u>-His-Leu-Asp-<u>Lys</u>-Gln-Thr-(OH)NH$_2$ g91) RNH-Gln-Pro-Asp-Xaa$_3$-Ile-Asn-Ala-Pro-Val-Thr-Xaa$_1$-Xaa$_2$-Tyr-Xaa$_4$-[linker]-Lys- (SEQ ID NO:1440)
Trp-Val-Gln-Asp-Ser-Met-<u>Asp</u>-His-Leu-Asp-<u>Lys</u>-Gln-Thr-(OH)NH$_2$ g92) RNH-Gln-Pro-Asp-Ala-Xaa$_3$-Asn-Ala-Pro-Val-Thr-Xaa$_1$-Xaa$_2$-Tyr-Xaa$_4$-[linker]-Lys- (SEQ ID NO:1441)
Trp-Val-Gln-Asp-Ser-Met-<u>Asp</u>-His-Leu-Asp-<u>Lys</u>-Gln-Thr-(OH)NH$_2$ g93) RNH-Gln-Pro-Asp-Ala-Ile-Xaa$_3$-Ala-Pro-Val-Thr-Xaa$_1$-Xaa$_2$-Tyr-Xaa$_4$-[linker]-Lys- (SEQ ID NO:1442)
Trp-Val-Gln-Asp-Ser-Met-<u>Asp</u>-His-Leu-Asp-<u>Lys</u>-Gln-Thr-(OH)NH$_2$ g94) RNH-Gln-Pro-Asp-Ala-Ile-Asn-Xaa$_3$-Pro-Val-Thr-Xaa$_1$-Xaa$_2$-Tyr-Xaa$_4$-[linker]-Lys- (SEQ ID NO:1443)
Trp-Val-Gln-Asp-Ser-Met-<u>Asp</u>-His-Leu-Asp-<u>Lys</u>-Gln-Thr-(OH)NH$_2$ g95) RNH-Gln-Pro-Asp-Ala-Ile-Asn-Ala-Xaa$_3$-Val-Thr-Xaa$_1$-Xaa$_2$-Tyr-Xaa$_4$-[linker]-Lys- (SEQ ID NO:1444)
Trp-Val-Gln-Asp-Ser-Met-<u>Asp</u>-His-Leu-Asp-<u>Lys</u>-Gln-Thr-(OH)NH$_2$ g96) RNH-Gln-Pro-Asp-Ala-Ile-Asn-Ala-Pro-Xaa$_3$-Thr-Xaa$_1$-Xaa$_2$-Tyr-Xaa$_4$-[linker]-Lys- (SEQ ID NO:1445)
Trp-Val-Gln-Asp-Ser-Met-<u>Asp</u>-His-Leu-Asp-<u>Lys</u>-Gln-Thr-(OH)NH$_2$ g97) RNH-Gln-Pro-Asp-Ala-Ile-Asn-Ala-Pro-Val-Xaa$_3$-Xaa$_1$-Xaa$_2$-Tyr-Xaa$_4$-[linker]-Lys- (SEQ ID NO:1446)
Trp-Val-Gln-Asp-Ser-Met-<u>Asp</u>-His-Leu-Asp-<u>Lys</u>-Gln-Thr-(OH)NH$_2$ In the above structures:

R is selected from the group consisting of hydrogen, alkyl, alkenyl, alkynyl, alkylcarbonyl, arylcarbonyl, aryl, PEG (polyethyleneglycol) and any other modifying group.

Xaa$_3$ is selected from the group consisting of L-Pro, D-Pro, P*, Btd and any L- or D-natural and non-natural amino acid.

Xaa$_4$ is selected from the group consisting of P*, Btd and any L- or D-natural amino acid and any non-natural amino acid.

P* is:

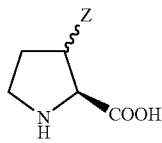

with Z=Ar, Ar—OH, alkyl and more

A wide variety of amino acid substitutions may be made in polypeptide sequences, such as lysine to glutamic acid, lysine to aspartic acid, Orn to Glu, or Orn to Asp. Moieties other than naturally occurring amino acids may also be substituted, such as Btd:

Btd* is:

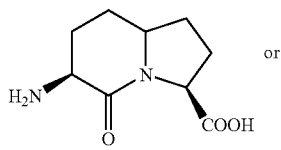

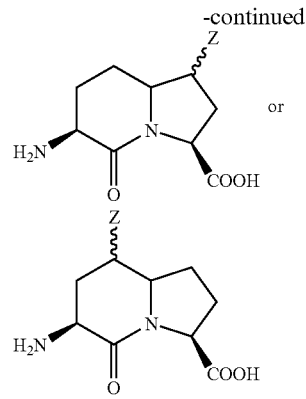

Z=Alkyl, Ar, Ar—OH and more

Xaa$_1$ is selected from the group consisting of any L- or D-natural amino acid and any non-natural amino acid.

Xaa$_2$ is selected from the group consisting of any L- or D-natural amino acid and any non-natural amino acid.

The linker is a bifunctional group covalently attached to the N-terminal and C-terminal portions of the analog having the structure: H$_2$N-Z$_4$-COOH wherein Z$_4$ is selected from the group consisting of: (1) alkyl, alkenyl, aralkyl, alkynyl; (2) —(CH$_2$)$_n$— wherein n is an integer n=9 to 14; (3) any combination of four natural amino acids or non-natural amino acids; and (4) -(Gly)$_4$- (SEQ ID NO: 1640).

CCL28 Compounds

Preferred embodiments of linear CCL28 analogs of the present invention corresponding to a portion of the N-terminal region of CCL28 having the following structures:

```
CCL28-(1-7) acid or amide
h1)    RNH-Ile-Leu-Pro-Ile-Ala-Ser-Ser-(OH)NH2                                           (SEQ ID NO:1447)

CCL28-(1-26) acid or amide
h2)    RNH-Ile-Leu-Pro-Ile-Ala-Ser-Ser-Cys-Cys-Thr-Glu-Val-Ser-His-His-Ile-Ser-Arg-Arg-  (SEQ ID NO:1448)
       Leu-Leu-Glu-Arg-Val-Asn-Met-(OH)NH2 h3)    RNH-Ile-Leu-Pro-Ile-Ala-Ser-Ser-Xaa1-Xaa2-Thr-Glu-Val-Ser-His-His-Ile-Ser-Arg-    (SEQ ID NO:1449)
       Arg-Leu-Leu-Glu-Arg-Val-Asn-Met-(OH)NH2 h4)    RNH-Xaa3-Leu-Pro-Ile-Ala-Ser-Ser-Xaa1-Xaa2-Thr-Glu-Val-Ser-His-His-Ile-Ser-Arg-   (SEQ ID NO:1450)
       Arg-Leu-Leu-Glu-Arg-Val-Asn-Met-(OH)NH2 h5)    RNH-Ile-Xaa3-Pro-Ile-Ala-Ser-Ser-Xaa1-Xaa2-Thr-Glu-Val-Ser-His-His-Ile-Ser-Arg-   (SEQ ID NO:1451)
       Arg-Leu-Leu-Glu-Arg-Val-Asn-Met-(OH)NH2 h6)    RNH-Ile-Leu-Xaa3-Ile-Ala-Ser-Ser-Xaa1-Xaa2-Thr-Glu-Val-Ser-His-His-Ile-Ser-Arg-   (SEQ ID NO:1452)
       Arg-Leu-Leu-Glu-Arg-Val-Asn-Met-(OH)NH2 h7)    RNH-Ile-Leu-Pro-Xaa3-Ala-Ser-Ser-Xaa1-Xaa2-Thr-Glu-Val-Ser-His-His-Ile-Ser-Arg-   (SEQ ID NO:1453)
       Arg-Leu-Leu-Glu-Arg-Val-Asn-Met-(OH)NH2 h8)    RNH-Ile-Leu-Pro-Ile-Xaa3-Ser-Ser-Xaa1-Xaa2-Thr-Glu-Val-Ser-His-His-Ile-Ser-Arg-   (SEQ ID NO:1454)
       Arg-Leu-Leu-Glu-Arg-Val-Asn-Met-(OH)NH2 h9)    RNH-Ile-Leu-Pro-Ile-Ala-Xaa3-Ser-Xaa1-Xaa2-Thr-Glu-Val-Ser-His-His-Ile-Ser-Arg-   (SEQ ID NO:1455)
       Arg-Leu-Leu-Glu-Arg-Val-Asn-Met-(OH)NH2 h10)   RNH-Ile-Leu-Pro-Ile-Ala-Ser-Xaa3-Xaa1-Xaa2-Thr-Glu-Val-Ser-His-His-Ile-Ser-Arg-   (SEQ ID NO:1456)
       Arg-Leu-Leu-Glu-Arg-Val-Asn-Met-(OH)NH2
```

Preferred embodiments of linear CCL28 analogs of the present invention corresponding to a portion of the internal region of CCL28 having the following structures:

```
CCL28-(10–26) acid or amide
h11)   RNH-Thr-Glu-Val-Ser-His-His-Ile-Ser-Arg-Arg-Leu-Leu-Glu-Arg-Val-Asn-Met-      (SEQ ID NO:1457)
       (OH)NH₂

CCL28-(27–49) acid or amide
h12)   RNH-Arg-Ile-Gln-Arg-Ala-Asp-Gly-Asp-Cys-Asp-Leu-Ala-Ala-Val-Ile-Leu-His-Val-  (SEQ ID NO:1458)
       Lys-Arg-Arg-Arg-Ile-(OH)NH₂

CCL28-(50–74) acid or amide
h13)   RNH-Val-Ser-Pro-His-Asn-His-Thr-Val-Lys-Gln-Trp-Met-Lys-Val-Gln-Ala-Ala-Lys-  (SEQ ID NO:1459)
       Lys-Asn-Gly-Lys-Gly-Asn-Val-(OH)NH₂
```

Preferred embodiments of linear CCL28 analogs of the present invention corresponding to a portion of the C-terminal region of CCL28 having the following structures:

```
CCL28-(75–102) acid or amide
h14)   RNH-His-Arg-Lys-Lys-His-His-Gly-Lys-Arg-Asn-Ser-Asn-Arg-Ala-His-Gln-Gly-Lys-  (SEQ ID NO:1460)
       His-Glu-Thr-Tyr-Gly-His-Lys-Thr-Pro-Tyr-(OH)NH₂
```

Preferred embodiments of linear CCL28 analogs of the present invention corresponding to a portion the N-terminal region joined with a linker to the C-terminal region of CCL28 having the following structures:

```
CCL28-(1–14)-[linker]-[Asp⁸⁶]-CCL28-(75–88) acid or amide
h15)   RNH-Ile-Leu-Pro-Ile-Ala-Ser-Ser-Cys-Cys-Thr-Glu-Val-Ser-His-[linker]-His-Arg-Lys-   (SEQ ID NO:1461)
       Lys-His-His-Gly-Lys-Arg-Asn-Ser-Asp-Arg-Ala-(OH)NH₂ h16)   RNH-Xaa₃-Leu-Pro-Ile-Ala-Ser-Ser-Xaa₁-Xaa₂-Thr-Glu-Val-Ser-His-[linker]-His-Arg-    (SEQ ID NO:1462)
       Lys-Lys-His-His-Gly-Lys-Arg-Asn-Ser-Asp-Arg-Ala-(OH)NH₂ h17)   RNH-Ile-Xaa₃-Pro-Ile-Ala-Ser-Ser-Xaa₁-Xaa₂-Thr-Glu-Val-Ser-His-[linker]-His-Arg-    (SEQ ID NO:1463)
       Lys-Lys-His-His-Gly-Lys-Arg-Asn-Ser-Asp-Arg-Ala-(OH)NH₂ h18)   RNH-Ile-Leu-Xaa₃-Ile-Ala-Ser-Ser-Xaa₁-Xaa₂-Thr-Glu-Val-Ser-His-[linker]-His-Arg-    (SEQ ID NO:1464)
       Lys-Lys-His-His-Gly-Lys-Arg-Asn-Ser-Asp-Arg-Ala-(OH)NH₂ h19)   RNH-Ile-Leu-Pro-Xaa₃-Ala-Ser-Ser-Xaa₁-Xaa₂-Thr-Glu-Val-Ser-His-[linker]-His-Arg-    (SEQ ID NO:1465)
       Lys-Lys-His-His-Gly-Lys-Arg-Asn-Ser-Asp-Arg-Ala-(OH)NH₂ h20)   RNH-Ile-Leu-Pro-Ile-Xaa₃-Ser-Ser-Xaa₁-Xaa₂-Thr-Glu-Val-Ser-His-[linker]-His-Arg-    (SEQ ID NO:1466)
       Lys-Lys-His-His-Gly-Lys-Arg-Asn-Ser-Asp-Arg-Ala-(OH)NH₂ h21)   RNH-Ile-Leu-Pro-Ile-Ala-Xaa₃-Ser-Xaa₁-Xaa₂-Thr-Glu-Val-Ser-His-[linker]-His-Arg-    (SEQ ID NO:1467)
       Lys-Lys-His-His-Gly-Lys-Arg-Asn-Ser-Asp-Arg-Ala-(OH)NH₂ h22)   RNH-Ile-Leu-Pro-Ile-Ala-Ser-Xaa₃-Xaa₁-Xaa₂-Thr-Glu-Val-Ser-His-[linker]-His-Arg-    (SEQ ID NO:1468)
       Lys-Lys-His-His-Gly-Lys-Arg-Asn-Ser-Asp-Arg-Ala-(OH)NH₂ h23)   RNH-Xaa₃-Leu-Pro-Ile-Ala-Ser-Ser-Xaa₁-Xaa₂-Xaa₄-Glu-Val-Ser-His-[linker]-His-       (SEQ ID NO:1469)
       Arg-Lys-Lys-His-His-Gly-Lys-Arg-Asn-Ser-Asp-Arg-Ala-(OH)NH₂ h24)   RNH-Ile-Xaa₃-Pro-Ile-Ala-Ser-Ser-Xaa₁-Xaa₂-Xaa₄-Glu-Val-Ser-His-[linker]-His-Arg-   (SEQ ID NO:1470)
       Lys-Lys-His-His-Gly-Lys-Arg-Asn-Ser-Asp-Arg-Ala-(OH)NH₂ h25)   RNH-Ile-Leu-Xaa₃-Ile-Ala-Ser-Ser-Xaa₁-Xaa₂-Xaa₄-Glu-Val-Ser-His-[linker]-His-Arg-   (SEQ ID NO:1471)
       Lys-Lys-His-His-Gly-Lys-Arg-Asn-Ser-Asp-Arg-Ala-(OH)NH₂ h26)   RNH-Ile-Leu-Pro-Xaa₃-Ala-Ser-Ser-Xaa₁-Xaa₂-Xaa₄-Glu-Val-Ser-His-[linker]-His-       (SEQ ID NO:1472)
       Arg-Lys-Lys-His-His-Gly-Lys-Arg-Asn-Ser-Asp-Arg-Ala(OH)NH₂ h27)   RNH-Ile-Leu-Pro-Ile-Xaa₃-Ser-Ser-Xaa₁-Xaa₂-Xaa₄-Glu-Val-Ser-His-[linker]-His-Arg-   (SEQ ID NO:1473)
       Lys-Lys-His-His-Gly-Lys-Arg-Asn-Ser-Asp-Arg-Ala(OH)NH₂ h28)   RNH-Ile-Leu-Pro-Ile-Ala-Xaa₃-Ser-Xaa₁-Xaa₂-Xaa₄-Glu-Val-Ser-His-[linker]-His-       (SEQ ID NO:1474)
       Arg-Lys-Lys-His-His-Gly-Lys-Arg-Asn-Ser-Asp-Arg-Ala(OH)-NH₂
```

-continued h29) RNH-Ile-Leu-Pro-Ile-Ala-Ser-Xaa$_3$-Xaa$_1$-Xaa$_2$-Xaa$_4$-Glu-Val-Ser-His-[linker]-His- (SEQ ID NO:1475)
Arg-Lys-Lys-His-His-Gly-Lys-Arg-Asn-Ser-Asp-Arg-Ala-(OH)NH$_2$ h30) RNH-Xaa$_3$-Leu-Pro-Ile-Ala-Ser-Ser-Xaa$_1$-Xaa$_2$-Thr-Xaa$_4$-Val-Ser-His-[linker]-His- (SEQ ID NO:1476)
Arg-Lys-Lys-His-His-Gly-Lys-Arg-Asn-Ser-Asp-Arg-Ala-(OH)NH$_2$ h31) RNH-Ile-Xaa$_3$-Pro-Ile-Ala-Ser-Ser-Xaa$_1$-Xaa$_2$-Thr-Xaa$_4$-Val-Ser-His-[linker]-His-Arg- (SEQ ID NO:1477)
Lys-Lys-His-His-Gly-Lys-Arg-Asn-Ser-Asp-Arg-Ala-(OH)NH$_2$ h32) RNH-Ile-Leu-Xaa$_3$-Ile-Ala-Ser-Ser-Xaa$_1$-Xaa$_2$-Thr-Xaa$_4$-Val-Ser-His-[linker]-His-Arg- (SEQ ID NO:1478)
Lys-Lys-His-His-Gly-Lys-Arg-Asn-Ser-Asp-Arg-Ala-(OH)NH$_2$ h33) RNH-Ile-Leu-Pro-Xaa$_3$-Ala-Ser-Ser-Xaa$_1$-Xaa$_2$-Thr-Xaa$_4$-Val-Ser-His-[linker]-His- (SEQ ID NO:1479)
Arg-Lys-Lys-His-His-Gly-Lys-Arg-Asn-Ser-Asp-Arg-Ala-(OH)NH$_2$ h34) RNH-Ile-Leu-Pro-Ile-Xaa$_3$-Ser-Ser-Xaa$_1$-Xaa$_2$-Thr-Xaa$_4$-Val-Ser-His-[linker]-His-Arg- (SEQ ID NO:1480)
Lys-Lys-His-His-Gly-Lys-Arg-Asn-Ser-Asp-Arg-Ala-(OH)NH$_2$ h35) RNH-Ile-Leu-Pro-Ile-Ala-Xaa$_3$-Ser-Xaa$_1$-Xaa$_2$-Thr-Xaa$_4$-Val-Ser-His-[linker]-His-Arg- (SEQ ID NO:1481)
Lys-Lys-His-His-Gly-Lys-Arg-Asn-Ser-Asp-Arg-Ala-(OH)NH$_2$ h36) RNH-Ile-Leu-Pro-Ile-Ala-Ser-Xaa$_3$-Xaa$_1$-Xaa$_2$-Thr-Xaa$_4$-Val-Ser-His-[linker]-His-Arg- (SEQ ID NO:1482)
Lys-Lys-His-His-Gly-Lys-Arg-Asn-Ser-Asp-Arg-Ala-(OH)NH$_2$ h37) RNH-Xaa$_3$-Leu-Pro-Ile-Ala-Ser-Ser-Xaa$_1$-Xaa$_2$-Thr-Glu-Xaa$_4$-Ser-His-[linker]-His- (SEQ ID NO:1483)
Arg-Lys-Lys-His-His-Gly-Lys-Arg-Asn-Ser-Asp-Arg-Ala-(OH)NH$_2$ h38) RNH-Ile-Xaa$_3$-Pro-Ile-Ala-Ser-Ser-Xaa$_1$-Xaa$_2$-Thr-Glu-Xaa$_4$-Ser-His-[linker]-His-Arg- (SEQ ID NO:1484)
Lys-Lys-His-His-Gly-Lys-Arg-Asn-Ser-Asp-Arg-Ala-(OH)NH$_2$ h39) RNH-Ile-Leu-Xaa$_3$-Ile-Ala-Ser-Ser-Xaa$_1$-Xaa$_2$-Thr-Glu-Xaa$_4$-Ser-His-[linker]-His-Arg- (SEQ ID NO:1485)
Lys-Lys-His-His-Gly-Lys-Arg-Asn-Ser-Asp-Arg-Ala-(OH)NH$_2$ h40) RNH-Ile-Leu-Pro-Xaa$_3$-Ala-Ser-Ser-Xaa$_1$-Xaa$_2$-Thr-Glu-Xaa$_4$-Ser-His-[linker]-His- (SEQ ID NO:1486)
Arg-Lys-Lys-His-His-Gly-Lys-Arg-Asn-Ser-Asp-Arg-Ala-(OH)NH$_2$ h41) RNH-Ile-Leu-Pro-Ile-Xaa$_3$-Ser-Ser-Xaa$_1$-Xaa$_2$-Thr-Glu-Xaa$_4$-Ser-His-[linker]-His-Arg- (SEQ ID NO:1487)
Lys-Lys-His-His-Gly-Lys-Arg-Asn-Ser-Asp-Arg-Ala-(OH)NH$_2$ h42) RNH-Ile-Leu-Pro-Ile-Ala-Xaa$_3$-Ser-Xaa$_1$-Xaa$_2$-Thr-Glu-Xaa$_4$-Ser-His-[linker]-His- (SEQ ID NO:1488)
Arg-Lys-Lys-His-His-Gly-Lys-Arg-Asn-Ser-Asp-Arg-Ala-(OH)NH$_2$ h43) RNH-Ile-Leu-Pro-Ile-Ala-Ser-Xaa$_3$-Xaa$_1$-Xaa$_2$-Thr-Glu-Xaa$_4$-Ser-His-[linker]-His- (SEQ ID NO:1489)
Arg-Lys-Lys-His-His-Gly-Lys-Arg-Asn-Ser-Asp-Arg-Ala-(OH)NH$_2$ h44) RNH-Xaa$_3$-Leu-Pro-Ile-Ala-Ser-Ser-Xaa$_1$-Xaa$_2$-Thr-Glu-Val-Xaa$_4$-His-[linker]-His- (SEQ ID NO:1490)
Arg-Lys-Lys-His-His-Gly-Lys-Arg-Asn-Ser-Asp-Arg-Ala-(OH)NH$_2$ h45) RNH-Ile-Xaa$_3$-Pro-Ile-Ala-Ser-Ser-Xaa$_1$-Xaa$_2$-Thr-Glu-Val-Xaa$_4$-His-[linker]-His-Arg- (SEQ ID NO:1491)
Lys-Lys-His-His-Gly-Lys-Arg-Asn-Ser-Asp-Arg-Ala-(OH)NH$_2$ h46) RNH-Ile-Leu-Xaa$_3$-Ile-Ala-Ser-Ser-Xaa$_1$-Xaa$_2$-Thr-Glu-Val-Xaa$_4$-His-[linker]-His- (SEQ ID NO:1492)
Arg-Lys-Lys-His-His-Gly-Lys-Arg-Asn-Ser-Asp-Arg-Ala-(OH)NH$_2$ h47) RNH-Ile-Leu-Pro-Xaa$_3$-Ala-Ser-Ser-Xaa$_1$-Xaa$_2$-Thr-Glu-Val-Xaa$_4$-His-[linker]-His- (SEQ ID NO:1493)
Arg-Lys-Lys-His-His-Gly-Lys-Arg-Asn-Ser-Asp-Arg-Ala-(OH)NH$_2$ h48) RNH-Ile-Leu-Pro-Ile-Xaa$_3$-Ser-Ser-Xaa$_1$-Xaa$_2$-Thr-Glu-Val-Xaa$_4$-His-[linker]-His- (SEQ ID NO:1494)
Arg-Lys-Lys-His-His-Gly-Lys-Arg-Asn-Ser-Asp-Arg-Ala-(OH)NH$_2$ h49) RNH-Ile-Leu-Pro-Ile-Ala-Xaa$_3$-Ser-Xaa$_1$-Xaa$_2$-Thr-Glu-Val-Xaa$_4$-His-[linker]-His- (SEQ ID NO:1495)
Arg-Lys-Lys-His-His-Gly-Lys-Arg-Asn-Ser-Asp-Arg-Ala-(OH)NH$_2$ h50) RNH-Ile-Leu-Pro-Ile-Ala-Ser-Xaa$_3$-Xaa$_1$-Xaa$_2$-Thr-Glu-Val-Xaa$_4$-His-[linker]-His- (SEQ ID NO:1496)
Arg-Lys-Lys-His-His-Gly-Lys-Arg-Asn-Ser-Asp-Arg-Ala-(OH)NH$_2$ h51) RNH-Xaa$_3$-Leu-Pro-Ile-Ala-Ser-Ser-Xaa$_1$-Xaa$_2$-Thr-Glu-Val-Ser-Xaa$_4$-[linker]-His- (SEQ ID NO:1497)
Arg-Lys-Lys-His-His-Gly-Lys-Arg-Asn-Ser-Asp-Arg-Ala-(OH)NH$_2$ h52) RNH-Ile-Xaa$_3$-Pro-Ile-Ala-Ser-Ser-Xaa$_1$-Xaa$_2$-Thr-Glu-Val-Ser-Xaa$_4$-[linker]-His-Arg- (SEQ ID NO:1498)
Lys-Lys-His-His-Gly-Lys-Arg-Asn-Ser-Asp-Arg-Ala-(OH)NH$_2$ h53) RNH-Ile-Leu-Xaa$_3$-Ile-Ala-Ser-Ser-Xaa$_1$-Xaa$_2$-Thr-Glu-Val-Ser-Xaa$_4$-[linker]-His- (SEQ ID NO:1499)
Arg-Lys-Lys-His-His-Gly-Lys-Arg-Asn-Ser-Asp-Arg-Ala-(OH)NH$_2$ h54) RNH-Ile-Leu-Pro-Xaa$_3$-Ala-Ser-Ser-Xaa$_1$-Xaa$_2$-Thr-Glu-Val-Ser-Xaa$_4$-[linker]-His- (SEQ ID NO:1500)
Arg-Lys-Lys-His-His-Gly-Lys-Arg-Asn-Ser-Asp-Arg-Ala-(OH)NH$_2$ -continued h55) RNH-Ile-Leu-Pro-Ile-Xaa₃-Ser-Ser-Xaa₁-Xaa₂-Thr-Glu-Val-Ser-Xaa₄-[linker]-His-Arg- (SEQ ID NO:1501)
Lys-Lys-His-His-Gly-Lys-Arg-Asn-Ser-Asp-Arg-Ala-(OH)NH₂ h56) RNH-Ile-Leu-Pro-Ile-Ala-Xaa₃-Ser-Xaa₁-Xaa₂-Thr-Glu-Val-Ser-Xaa₄-[linker]-His- (SEQ ID NO:1502)
Arg-Lys-Lys-His-His-Gly-Lys-Arg-Asn-Ser-Asp-Arg-Ala-(OH)NH₂ h57) RNH-Ile-Leu-Pro-Ile-Ala-Ser-Xaa₃-Xaa₁-Xaa₂-Thr-Glu-Val-Ser-Xaa₄-[linker]-His- (SEQ ID NO:1503)
Arg-Lys-Lys-His-His-Gly-Lys-Arg-Asn-Ser-Asp-Arg-Ala-(OH)NH₂

CCL28-(1–14)-[linker]-CCL28-(88–102) acid or amide h58) RNH-Xaa₃-Leu-Pro-Ile-Ala-Ser-Ser-Xaa₁-Xaa₂-Thr-Glu-Val-Ser-His-[linker]-Ala-His- (SEQ ID NO:1504)
Gln-Gly-Lys-His-Glu-Thr-Tyr-Gly-His-Lys-Thr-Pro-Tyr-(OH)NH₂ h59) RNH-Ile-Xaa₃-Pro-Ile-Ala-Ser-Ser-Xaa₁-Xaa₂-Thr-Glu-Val-Ser-His-[linker]-Ala-His- (SEQ ID NO:1505)
Gln-Gly-Lys-His-Glu-Thr-Tyr-Gly-His-Lys-Thr-Pro-Tyr-(OH)NH₂ h60) RNH-Ile-Leu-Xaa₃-Ile-Ala-Ser-Ser-Xaa₁-Xaa₂-Thr-Glu-Val-Ser-His-[linker]-Ala-His- (SEQ ID NO:1506)
Gln-Gly-Lys-His-Glu-Thr-Tyr-Gly-His-Lys-Thr-Pro-Tyr-(OH)NH₂ h61) RNH-Ile-Leu-Pro-Xaa₃-Ala-Ser-Ser-Xaa₁-Xaa₂-Thr-Glu-Val-Ser-His-[linker]-Ala-His- (SEQ ID NO:1507)
Gln-Gly-Lys-His-Glu-Thr-Tyr-Gly-His-Lys-Thr-Pro-Tyr-(OH)NH₂ h62) RNH-Ile-Leu-Pro-Ile-Xaa₃-Ser-Ser-Xaa₁-Xaa₂-Thr-Glu-Val-Ser-His-[linker]-Ala-His- (SEQ ID NO:1508)
Gln-Gly-Lys-His-Glu-Thr-Tyr-Gly-His-Lys-Thr-Pro-Tyr-(OH)NH₂ h63) RNH-Ile-Leu-Pro-Ile-Ala-Xaa₃-Ser-Xaa₁-Xaa₂-Thr-Glu-Val-Ser-His-[linker]-Ala-His- (SEQ ID NO:1509)
Gln-Gly-Lys-His-Glu-Thr-Tyr-Gly-His-Lys-Thr-Pro-Tyr-(OH)NH₂ h64) RNH-Ile-Leu-Pro-Ile-Ala-Ser-Xaa₃-Xaa₁-Xaa₂-Thr-Glu-Val-Ser-His-[linker]-Ala-His- (SEQ ID NO:1510)
Gln-Gly-Lys-His-Glu-Thr-Tyr-Gly-His-Lys-Thr-Pro-Tyr-(OH)NH₂ h65) RNH-Xaa₃-Leu-Pro-Ile-Ala-Ser-Ser-Xaa₁-Xaa₂-Xaa₄-Glu-Val-Ser-His-[linker]-Ala- (SEQ ID NO:1511)
His-Gln-Gly-Lys-His-Glu-Thr-Tyr-Gly-His-Lys-Thr-Pro-Tyr-(OH)NH₂ h66) RNH-Ile-Xaa₃-Pro-Ile-Ala-Ser-Ser-Xaa₁-Xaa₂-Xaa₄-Glu-Val-Ser-His-[linker]-Ala-His- (SEQ ID NO:1512)
Gln-Gly-Lys-His-Glu-Thr-Tyr-Gly-His-Lys-Thr-Pro-Tyr-(OH)NH₂ h67) RNH-Ile-Leu-Xaa₃-Ile-Ala-Ser-Ser-Xaa₁-Xaa₂-Xaa₄-Glu-Val-Ser-His-[linker]-Ala-His- (SEQ ID NO:1513)
Gln-Gly-Lys-His-Glu-Thr-Tyr-Gly-His-Lys-Thr-Pro-Tyr-(OH)NH₂ h68) RNH-Ile-Leu-Pro-Xaa₃-Ala-Ser-Ser-Xaa₁-Xaa₂-Xaa₄-Glu-Val-Ser-His-[linker]-Ala- (SEQ ID NO:1514)
His-Gln-Gly-Lys-His-Glu-Thr-Tyr-Gly-His-Lys-Thr-Pro-Tyr-(OH)NH₂ h69) RNH-Ile-Leu-Pro-Ile-Xaa₃-Ser-Ser-Xaa₁-Xaa₂-Xaa₄-Glu-Val-Ser-His-[linker]-Ala-His- (SEQ ID NO:1515)
Gln-Gly-Lys-His-Glu-Thr-Tyr-Gly-His-Lys-Thr-Pro-Tyr-(OH)NH₂ h70) RNH-Ile-Leu-Pro-Ile-Ala-Xaa₃-Ser-Xaa₁-Xaa₂-Xaa₄-Glu-Val-Ser-His-[linker]-Ala-His- (SEQ ID NO:1516)
Gln-Gly-Lys-His-Glu-Thr-Tyr-Gly-His-Lys-Thr-Pro-Tyr-(OH)NH₂ h71) RNH-Ile-Leu-Pro-Ile-Ala-Ser-Xaa₃-Xaa₁-Xaa₂-Xaa₄-Glu-Val-Ser-His-[linker]-Ala-His- (SEQ ID NO:1517)
Gln-Gly-Lys-His-Glu-Thr-Tyr-Gly-His-Lys-Thr-Pro-Tyr-(OH)NH₂ h72) RNH-Xaa₃-Leu-Pro-Ile-Ala-Ser-Ser-Xaa₁-Xaa₂-Thr-Xaa₄-Val-Ser-His-[linker]-Ala- (SEQ ID NO:1518)
His-Gln-Gly-Lys-His-Glu-Thr-Tyr-Gly-His-Lys-Thr-Pro-Tyr-(OH)NH₂ h73) RNH-Ile-Xaa₃-Pro-Ile-Ala-Ser-Ser-Xaa₁-Xaa₂-Thr-Xaa₄-Val-Ser-His-[linker]-Ala-His- (SEQ ID NO:1519)
Gln-Gly-Lys-His-Glu-Thr-Tyr-Gly-His-Lys-Thr-Pro-Tyr-(OH)NH₂ h74) RNH-Ile-Leu-Xaa₃-Ile-Ala-Ser-Ser-Xaa₁-Xaa₂-Thr-Xaa₄-Val-Ser-His-[linker]-Ala-His- (SEQ ID NO:1520)
Gln-Gly-Lys-His-Glu-Thr-Tyr-Gly-His-Lys-Thr-Pro-Tyr-(OH)NH₂ h75) RNH-Ile-Leu-Pro-Xaa₃-Ala-Ser-Ser-Xaa₁-Xaa₂-Thr-Xaa₄-Val-Ser-His-[linker]-Ala- (SEQ ID NO:1521)
His-Gln-Gly-Lys-His-Glu-Thr-Tyr-Gly-His-Lys-Thr-Pro-Tyr-(OH)NH₂ h76) RNH-Ile-Leu-Pro-Ile-Xaa₃-Ser-Ser-Xaa₁-Xaa₂-Thr-Xaa₄-Val-Ser-His-[linker]-Ala-His- (SEQ ID NO:1522)
Gln-Gly-Lys-His-Glu-Thr-Tyr-Gly-His-Lys-Thr-Pro-Tyr-(OH)NH₂ h77) RNH-Ile-Leu-Pro-Ile-Ala-Xaa₃-Ser-Xaa₁-Xaa₂-Thr-Xaa₄-Val-Ser-His-[linker]-Ala-His- (SEQ ID NO:1523)
Gln-Gly-Lys-His-Glu-Thr-Tyr-Gly-His-Lys-Thr-Pro-Tyr-(OH)NH₂ h78) RNH-Ile-Leu-Pro-Ile-Ala-Ser-Xaa₃-Xaa₁-Xaa₂-Thr-Xaa₄-Val-Ser-His-[linker]-Ala-His- (SEQ ID NO:1524)
Gln-Gly-Lys-His-Glu-Thr-Tyr-Gly-His-Lys-Thr-Pro-Tyr-(OH)NH₂ h79) RNH-Xaa₃-Leu-Pro-Ile-Ala-Ser-Ser-Xaa₁-Xaa₂-Thr-Glu-Xaa₄-Ser-His-[linker]-Ala- (SEQ ID NO:1525)
His-Gln-Gly-Lys-His-Glu-Thr-Tyr-Gly-His-Lys-Thr-Pro-Tyr-(OH)NH₂ h80) RNH-Ile-Xaa₃-Pro-Ile-Ala-Ser-Ser-Xaa₁-Xaa₂-Thr-Glu-Xaa₄-Ser-His-[linker]-Ala-His- (SEQ ID NO:1526)
Gln-Gly-Lys-His-Glu-Thr-Tyr-Gly-His-Lys-Thr-Pro-Tyr-(OH)NH₂

-continued
h81)   RNH-Ile-Leu-Xaa₃-Ile-Ala-Ser-Ser-Xaa₁-Xaa₂-Thr-Glu-Xaa₄-Ser-His-[linker]-Ala-His-    (SEQ ID NO:1527)
       Gln-Gly-Lys-His-Glu-Thr-Tyr-Gly-His-Lys-Thr-Pro-Tyr-(OH)NH₂ h82)   RNH-Ile-Leu-Pro-Xaa₃-Ala-Ser-Ser-Xaa₁-Xaa₂-Thr-Glu-Xaa₄-Ser-His-[linker]-Ala-        (SEQ ID NO:1528)
       His-Gln-Gly-Lys-His-Glu-Thr-Tyr-Gly-His-Lys-Thr-Pro-Tyr-(OH)NH₂ h83)   RNH-Ile-Leu-Pro-Ile-Xaa₃-Ser-Ser-Xaa₁-Xaa₂-Thr-Glu-Xaa₄-Ser-His-[linker]-Ala-His-    (SEQ ID NO:1529)
       Gln-Gly-Lys-His-Glu-Thr-Tyr-Gly-His-Lys-Thr-Pro-Tyr-(OH)NH₂ h84)   RNH-Ile-Leu-Pro-Ile-Ala-Xaa₃-Ser-Xaa₁-Xaa₂-Thr-Glu-Xaa₄-Ser-His-[linker]-Ala-His-    (SEQ ID NO:1530)
       Gln-Gly-Lys-His-Glu-Thr-Tyr-Gly-His-Lys-Thr-Pro-Tyr-(OH)NH₂ h85)   RNH-Ile-Leu-Pro-Ile-Ala-Ser-Xaa₃-Xaa₁-Xaa₂-Thr-Glu-Xaa₄-Ser-His-[linker]-Ala-His-    (SEQ ID NO:1531)
       Gln-Gly-Lys-His-Glu-Thr-Tyr-Gly-His-Lys-Thr-Pro-Tyr-(OH)NH₂ h86)   RNH-Xaa₃-Leu-Pro-Ile-Ala-Ser-Ser-Xaa₁-Xaa₂-Thr-Glu-Val-Xaa₄-His-[linker]-Ala-        (SEQ ID NO:1532)
       His-Gln-Gly-Lys-His-Glu-Thr-Tyr-Gly-His-Lys-Thr-Pro-Tyr-(OH)NH₂ h87)   RNH-Ile-Xaa₃-Pro-Ile-Ala-Ser-Ser-Xaa₁-Xaa₂-Thr-Glu-Val-Xaa₄-His-[linker]-Ala-His-    (SEQ ID NO:1533)
       Gln-Gly-Lys-His-Glu-Thr-Tyr-Gly-His-Lys-Thr-Pro-Tyr-(OH)NH₂ h88)   RNH-Ile-Leu-Xaa₃-Ile-Ala-Ser-Ser-Xaa₁-Xaa₂-Thr-Glu-Val-Xaa₄-His-[linker]-Ala-His-    (SEQ ID NO:1534)
       Gln-Gly-Lys-His-Glu-Thr-Tyr-Gly-His-Lys-Thr-Pro-Tyr-(OH)NH₂ h89)   RNH-Ile-Leu-Pro-Xaa₃-Ala-Ser-Ser-Xaa₁-Xaa₂-Thr-Glu-Val-Xaa₄-His-[linker]-Ala-        (SEQ ID NO:1535)
       His-Gln-Gly-Lys-His-Glu-Thr-Tyr-Gly-His-Lys-Thr-Pro-Tyr-(OH)NH₂ h90)   RNH-Ile-Leu-Pro-Ile-Xaa₃-Ser-Ser-Xaa₁-Xaa₂-Thr-Glu-Val-Xaa₄-His-[linker]-Ala-His-    (SEQ ID NO:1536)
       Gln-Gly-Lys-His-Glu-Thr-Tyr-Gly-His-Lys-Thr-Pro-Tyr-(OH)NH₂ h91)   RNH-Ile-Leu-Pro-Ile-Ala-Xaa₃-Ser-Xaa₁-Xaa₂-Thr-Glu-Val-Xaa₄-His-[linker]-Ala-        (SEQ ID NO:1537)
       His-Gln-Gly-Lys-His-Glu-Thr-Tyr-Gly-His-Lys-Thr-Pro-Tyr-(OH)NH₂ h92)   RNH-Ile-Leu-Pro-Ile-Ala-Ser-Xaa₃-Xaa₁-Xaa₂-Thr-Glu-Val-Xaa₄-His-[linker]-Ala-        (SEQ ID NO:1538)
       His-Gln-Gly-Lys-His-Glu-Thr-Tyr-Gly-His-Lys-Thr-Pro-Tyr-(OH)NH₂ h93)   RNH-Xaa₃-Leu-Pro-Ile-Ala-Ser-Ser-Xaa₁-Xaa₂-Thr-Glu-Val-Ser-Xaa₄-[linker]-Ala-        (SEQ ID NO:1539)
       His-Gln-Gly-Lys-His-Glu-Thr-Tyr-Gly-His-Lys-Thr-Pro-Tyr-(OH)NH₂ h94)   RNH-Ile-Xaa₃-Pro-Ile-Ala-Ser-Ser-Xaa₁-Xaa₂-Thr-Glu-Val-Ser-Xaa₄-[linker]-Ala-His-    (SEQ ID NO:1540)
       Gln-Gly-Lys-His-Glu-Thr-Tyr-Gly-His-Lys-Thr-Pro-Tyr-(OH)NH₂ h95)   RNH-Ile-Leu-Xaa₃-Ile-Ala-Ser-Ser-Xaa₁-Xaa₂-Thr-Glu-Val-Ser-Xaa₄-[linker]-Ala-His-    (SEQ ID NO:1541)
       Gln-Gly-Lys-His-Glu-Thr-Tyr-Gly-His-Lys-Thr-Pro-Tyr-(OH)NH₂ h96)   RNH-Ile-Leu-Pro-Xaa₃-Ala-Ser-Ser-Xaa₁-Xaa₂-Thr-Glu-Val-Ser-Xaa₄-[linker]-Ala-        (SEQ ID NO:1542)
       His-Gln-Gly-Lys-His-Glu-Thr-Tyr-Gly-His-Lys-Thr-Pro-Tyr-(OH)NH₂ h97)   RNH-Ile-Leu-Pro-Ile-Xaa₃-Ser-Ser-Xaa₁-Xaa₂-Thr-Glu-Val-Ser-Xaa₄-[linker]-Ala-His-    (SEQ ID NO:1543)
       Gln-Gly-Lys-His-Glu-Thr-Tyr-Gly-His-Lys-Thr-Pro-Tyr-(OH)NH₂ h98)   RNH-Ile-Leu-Pro-Ile-Ala-Xaa₃-Ser-Xaa₁-Xaa₂-Thr-Glu-Val-Ser-Xaa₄-[linker]-Ala-His-    (SEQ ID NO:1544)
       Gln-Gly-Lys-His-Glu-Thr-Tyr-Gly-His-Lys-Thr-Pro-Tyr-(OH)NH₂ h99)   RNH-Ile-Leu-Pro-Ile-Ala-Ser-Xaa₃-Xaa₁-Xaa₂-Thr-Glu-Val-Ser-Xaa₄-[linker]-Ala-His-    (SEQ ID NO:1545)
       Gln-Gly-Lys-His-Glu-Thr-Tyr-Gly-His-Lys-Thr-Pro-Tyr-(OH)NH₂
```

Preferred embodiments of cyclic CCL28 analogs of the present invention corresponding to a portion the N-terminal region joined with a linker to a cyclic portion of the C-terminal region of CCL28 having the following structures:

```
CCL28-(1-14)-[linker]-[Asp⁸⁶]-CCL28-(75-88)-cyclic(Lys82–Asp86) acid or amide
h100)  RNH-Ile-Leu-Pro-Ile-Ala-Ser-Ser-Cys-Cys-Thr-Glu-Val-Ser-His-[linker]-His-Arg-        (SEQ ID NO:1546)
       Lys-Lys-His-His-Gly-Lys-Arg-Asn-Ser-Asp-Arg-Ala-(OH)NH₂ h101)  RNH-Xaa₃-Leu-Pro-Ile-Ala-Ser-Ser-Xaa₁-Xaa₂-Thr-Glu-Val-Ser-His-[linker]-His-         (SEQ ID NO:1547)
       Arg-Lys-Lys-His-His-Gly-Lys-Arg-Asn-Ser-Asp-Arg-Ala-(OH)NH₂ h102)  RNH-Ile-Xaa₃-Pro-Ile-Ala-Ser-Ser-Xaa₁-Xaa₂-Thr-Glu-Val-Ser-His-[linker]-His-         (SEQ ID NO:1548)
       Arg-Lys-Lys-His-His-Gly-Lys-Arg-Asn-Ser-Asp-Arg-Ala-(OH)NH₂ h103)  RNH-Ile-Leu-Xaa₃-Ile-Ala-Ser-Ser-Xaa₁-Xaa₂-Thr-Glu-Val-Ser-His-[linker]-His-         (SEQ ID NO:1549)
       Arg-Lys-Lys-His-His-Gly-Lys-Arg-Asn-Ser-Asp-Arg-Ala-(OH)NH₂

-continued h104) RNH-Ile-Leu-Pro-Xaa₃-Ala-Ser-Ser-Xaa₁-Xaa₂-Thr-Glu-Val-Ser-His-[linker]-His-  (SEQ ID NO:1550)
Arg-Lys-Lys-His-His-Gly-<u>Lys</u>-Arg-Asn-Ser-<u>Asp</u>-Arg-Ala-(OH)NH₂ h105) RNH-Ile-Leu-Pro-Ile-Xaa₃-Ser-Ser-Xaa₁-Xaa₂-Thr-Glu-Val-Ser-His-[linker]-His-  (SEQ ID NO:1551)
Arg-Lys-Lys-His-His-Gly-<u>Lys</u>-Arg-Asn-Ser-<u>Asp</u>-Arg-Ala-(OH)NH₂ h106) RNH-Ile-Leu-Pro-Ile-Ala-Xaa₃-Ser-Xaa₁-Xaa₂-Thr-Glu-Val-Ser-His-[linker]-His-  (SEQ ID NO:1552)
Arg-Lys-Lys-His-His-Gly-<u>Lys</u>-Arg-Asn-Ser-<u>Asp</u>-Arg-Ala-(OH)NH₂ h107) RNH-Ile-Leu-Pro-Ile-Ala-Ser-Xaa₃-Xaa₁-Xaa₂-Thr-Glu-Val-Ser-His-[linker]-His-  (SEQ ID NO:1553)
Arg-Lys-Lys-His-His-Gly-<u>Lys</u>-Arg-Asn-Ser-<u>Asp</u>-Arg-Ala-(OH)NH₂ h108) RNH-Xaa₃-Leu-Pro-Ile-Ala-Ser-Ser-Xaa₁-Xaa₂-Xaa₄-Glu-Val-Ser-His-[linker]-His-  (SEQ ID NO:1554)
Arg-Lys-Lys-His-His-Gly-<u>Lys</u>-Arg-Asn-Ser-<u>Asp</u>-Arg-Ala-(OH)NH₂ h109) RNH-Ile-Xaa₃-Pro-Ile-Ala-Ser-Ser-Xaa₁-Xaa₂-Xaa₄-Glu-Val-Ser-His-[linker]-His-  (SEQ ID NO:1555)
Arg-Lys-Lys-His-His-Gly-<u>Lys</u>-Arg-Asn-Ser-<u>Asp</u>-Arg-Ala-(OH)NH₂ h110) RNH-Ile-Leu-Xaa₃-Ile-Ala-Ser-Ser-Xaa₁-Xaa₂-Xaa₄-Glu-Val-Ser-His-[linker]-His-  (SEQ ID NO:1556)
Arg-Lys-Lys-His-His-Gly-<u>Lys</u>-Arg-Asn-Ser-<u>Asp</u>-Arg-Ala-(OH)NH₂ h111) RNH-Ile-Leu-Pro-Xaa₃-Ala-Ser-Ser-Xaa₁-Xaa₂-Xaa₄-Glu-Val-Ser-His-[linker]-His-  (SEQ ID NO:1557)
Arg-Lys-Lys-His-His-Gly-<u>Lys</u>-Arg-Asn-Ser-<u>Asp</u>-Arg-Ala-(OH)NH₂ h112) RNH-Ile-Leu-Pro-Ile-Xaa₃-Ser-Ser-Xaa₁-Xaa₂-Xaa₄-Glu-Val-Ser-His-[linker]-His-  (SEQ ID NO:1558)
Arg-Lys-Lys-His-His-Gly-<u>Lys</u>-Arg-Asn-Ser-<u>Asp</u>-Arg-Ala-(OH)NH₂ h113) RNH-Ile-Leu-Pro-Ile-Ala-Xaa₃-Ser-Xaa₁-Xaa₂-Xaa₄-Glu-Val-Ser-His-[linker]-His-  (SEQ ID NO:1559)
Arg-Lys-Lys-His-His-Gly-<u>Lys</u>-Arg-Asn-Ser-<u>Asp</u>-Arg-Ala-(OH)NH₂ h114) RNH-Ile-Leu-Pro-Ile-Ala-Ser-Xaa₃-Xaa₁-Xaa₂-Xaa₄-Glu-Val-Ser-His-[linker]-His-  (SEQ ID NO:1560)
Arg-Lys-Lys-His-His-Gly-<u>Lys</u>-Arg-Asn-Ser-<u>Asp</u>-Arg-Ala-(OH)NH₂ h115) RNH-Xaa₃-Leu-Pro-Ile-Ala-Ser-Ser-Xaa₁-Xaa₂-Thr-Xaa₄-Val-Ser-His-[linker]-His-  (SEQ ID NO:1561)
Arg-Lys-Lys-His-His-Gly-<u>Lys</u>-Arg-Asn-Ser-<u>Asp</u>-Arg-Ala-(OH)NH₂ h116) RNH-Ile-Xaa₃-Pro-Ile-Ala-Ser-Ser-Xaa₁-Xaa₂-Thr-Xaa₄-Val-Ser-His-[linker]-His-  (SEQ ID NO:1562)
Arg-Lys-Lys-His-His-Gly-<u>Lys</u>-Arg-Asn-Ser-<u>Asp</u>-Arg-Ala-(OH)NH₂ h117) RNH-Ile-Leu-Xaa₃-Ile-Ala-Ser-Ser-Xaa₁-Xaa₂-Thr-Xaa₄-Val-Ser-His-[linker]-His-  (SEQ ID NO:1563)
Arg-Lys-Lys-His-His-Gly-<u>Lys</u>-Arg-Asn-Ser-<u>Asp</u>-Arg-Ala-(OH)NH₂ h118) RNH-Ile-Leu-Pro-Xaa₃-Ala-Ser-Ser-Xaa₁-Xaa₂-Thr-Xaa₄-Val-Ser-His-[linker]-His-  (SEQ ID NO:1564)
Arg-Lys-Lys-His-His-Gly-<u>Lys</u>-Arg-Asn-Ser-<u>Asp</u>-Arg-Ala-(OH)NH₂ h119) RNH-Ile-Leu-Pro-Ile-Xaa₃-Ser-Ser-Xaa₁-Xaa₂-Thr-Xaa₄-Val-Ser-His-[linker]-His-  (SEQ ID NO:1565)
Arg-Lys-Lys-His-His-Gly-<u>Lys</u>-Arg-Asn-Ser-<u>Asp</u>-Arg-Ala-(OH)NH₂ h120) RNH-Ile-Leu-Pro-Ile-Ala-Xaa₃-Ser-Xaa₁-Xaa₂-Thr-Xaa₄-Val-Ser-His-[linker]-His-  (SEQ ID NO:1566)
Arg-Lys-Lys-His-His-Gly-<u>Lys</u>-Arg-Asn-Ser-<u>Asp</u>-Arg-Ala-(OH)NH₂ h121) RNH-Ile-Leu-Pro-Ile-Ala-Ser-Xaa₃-Xaa₁-Xaa₂-Thr-Xaa₄-Val-Ser-His-[linker]-His-  (SEQ ID NO:1567)
Arg-Lys-Lys-His-His-Gly-<u>Lys</u>-Arg-Asn-Ser-<u>Asp</u>-Arg-Ala-(OH)NH₂ h122) RNH-Xaa₃-Leu-Pro-Ile-Ala-Ser-Ser-Xaa₁-Xaa₂-Thr-Glu-Xaa₄-Ser-His-[linker]-His-  (SEQ ID NO:1568)
Arg-Lys-Lys-His-His-Gly-<u>Lys</u>-Arg-Asn-Ser-<u>Asp</u>-Arg-Ala-(OH)NH₂ h123) RNH-Ile-Xaa₃-Pro-Ile-Ala-Ser-Ser-Xaa₁-Xaa₂-Thr-Glu-Xaa₄-Ser-His-[linker]-His-  (SEQ ID NO:1569)
Arg-Lys-Lys-His-His-Gly-<u>Lys</u>-Arg-Asn-Ser-<u>Asp</u>-Arg-Ala-(OH)NH₂ h124) RNH-Ile-Leu-Xaa₃-Ile-Ala-Ser-Ser-Xaa₁-Xaa₂-Thr-Glu-Xaa₄-Ser-His-[linker]-His-  (SEQ ID NO:1570)
Arg-Lys-Lys-His-His-Gly-<u>Lys</u>-Arg-Asn-Ser-<u>Asp</u>-Arg-Ala-(OH)NH₂ h125) RNH-Ile-Leu-Pro-Xaa₃-Ala-Ser-Ser-Xaa₁-Xaa₂-Thr-Glu-Xaa₄-Ser-His-[linker]-His-  (SEQ ID NO:1571)
Arg-Lys-Lys-His-His-Gly-<u>Lys</u>-Arg-Asn-Ser-<u>Asp</u>-Arg-Ala-(OH)NH₂ h125) RNH-Ile-Leu-Pro-Ile-Xaa₃-Ser-Ser-Xaa₁-Xaa₂-Thr-Glu-Xaa₄-Ser-His-[linker]-His-  (SEQ ID NO:1572)
Arg-Lys-Lys-His-His-Gly-<u>Lys</u>-Arg-Asn-Ser-<u>Asp</u>-Arg-Ala-(OH)NH₂ h126) RNH-Ile-Leu-Pro-Ile-Ala-Xaa₃-Ser-Xaa₁-Xaa₂-Thr-Glu-Xaa₄-Ser-His-[linker]-His-  (SEQ ID NO:1573)
Arg-Lys-Lys-His-His-Gly-<u>Lys</u>-Arg-Asn-Ser-<u>Asp</u>-Arg-Ala-(OH)NH₂ h127) RNH-Ile-Leu-Pro-Ile-Ala-Ser-Xaa₃-Xaa₁-Xaa₂-Thr-Glu-Xaa₄-Ser-His-[linker]-His-  (SEQ ID NO:1574)
Arg-Lys-Lys-His-His-Gly-<u>Lys</u>-Arg-Asn-Ser-<u>Asp</u>-Arg-Ala-(OH)NH₂ h128) RNH-Xaa₃-Leu-Pro-Ile-Ala-Ser-Ser-Xaa₁-Xaa₂-Thr-Glu-Val-Xaa₄-His-[linker]-His-  (SEQ ID NO:1575)
Arg-Lys-Lys-His-His-Gly-<u>Lys</u>-Arg-Asn-Ser-<u>Asp</u>-Arg-Ala-(OH)NH₂

-continued h129) RNH-Ile-Xaa₃-Pro-Ile-Ala-Ser-Ser-Xaa₁-Xaa₂-Thr-Glu-Val-Xaa₄-His-[linker]-His-  (SEQ ID NO:1576)
Arg-Lys-Lys-His-His-Gly-<u>Lys</u>-Arg-Asn-Ser-<u>Asp</u>-Arg-Ala-(OH)NH₂ h130) RNH-Ile-Leu-Xaa₃-Ile-Ala-Ser-Ser-Xaa₁-Xaa₂-Thr-Glu-Val-Xaa₄-His-[linker]-His-  (SEQ ID NO:1577)
Arg-Lys-Lys-His-His-Gly-<u>Lys</u>-Arg-Asn-Ser-<u>Asp</u>-Arg-Ala-(OH)NH₂ h131) RNH-Ile-Leu-Pro-Xaa₃-Ala-Ser-Ser-Xaa₁-Xaa₂-Thr-Glu-Val-Xaa₄-His-[linker]-His-  (SEQ ID NO:1578)
Arg-Lys-Lys-His-His-Gly-<u>Lys</u>-Arg-Asn-Ser-<u>Asp</u>-Arg-Ala-(OH)NH₂ h132) RNH-Ile-Leu-Pro-Ile-Xaa₃-Ser-Ser-Xaa₁-Xaa₂-Thr-Glu-Val-Xaa₄-His-[linker]-His-  (SEQ ID NO:1579)
Arg-Lys-Lys-His-His-Gly-<u>Lys</u>-Arg-Asn-Ser-<u>Asp</u>-Arg-Ala-(OH)NH₂ h133) RNH-Ile-Leu-Pro-Ile-Ala-Xaa₃-Ser-Xaa₁-Xaa₂-Thr-Glu-Val-Xaa₄-His-[linker]-His-  (SEQ ID NO:1580)
Arg-Lys-Lys-His-His-Gly-<u>Lys</u>-Arg-Asn-Ser-<u>Asp</u>-Arg-Ala-(OH)NH₂ h134) RNH-Ile-Leu-Pro-Ile-Ala-Ser-Xaa₃-Xaa₁-Xaa₂-Thr-Glu-Val-Xaa₄-His-[linker]-His-  (SEQ ID NO:1581)
Arg-Lys-Lys-His-His-Gly-<u>Lys</u>-Arg-Asn-Ser-<u>Asp</u>-Arg-Ala-(OH)NH₂ h135) RNH-Xaa₃-Leu-Pro-Ile-Ala-Ser-Ser-Xaa₁-Xaa₂-Thr-Glu-Val-Ser-Xaa₄-[linker]-His-  (SEQ ID NO:1582)
Arg-Lys-Lys-His-His-Gly-<u>Lys</u>-Arg-Asn-Ser-<u>Asp</u>-Arg-Ala-(OH)NH₂ h136) RNH-Ile-Xaa₃-Pro-Ile-Ala-Ser-Ser-Xaa₁-Xaa₂-Thr-Glu-Val-Ser-Xaa₄-[linker]-His-  (SEQ ID NO:1583)
Arg-Lys-Lys-His-His-Gly-<u>Lys</u>-Arg-Asn-Ser-<u>Asp</u>-Arg-Ala-(OH)NH₂ h137) RNH-Ile-Leu-Xaa₃-Ile-Ala-Ser-Ser-Xaa₁-Xaa₂-Thr-Glu-Val-Ser-Xaa₄-[linker]-His-  (SEQ ID NO:1584)
Arg-Lys-Lys-His-His-Gly-<u>Lys</u>-Arg-Asn-Ser-<u>Asp</u>-Arg-Ala-(OH)NH₂ h138) RNH-Ile-Leu-Pro-Xaa₃-Ala-Ser-Ser-Xaa₁-Xaa₂-Thr-Glu-Val-Ser-Xaa₄-[linker]-His-  (SEQ ID NO:1585)
Arg-Lys-Lys-His-His-Gly-<u>Lys</u>-Arg-Asn-Ser-<u>Asp</u>-Arg-Ala-(OH)NH₂ h139) RNH-Ile-Leu-Pro-Ile-Xaa₃-Ser-Ser-Xaa₁-Xaa₂-Thr-Glu-Val-Ser-Xaa₄-[linker]-His-  (SEQ ID NO:1586)
Arg-Lys-Lys-His-His-Gly-<u>Lys</u>-Arg-Asn-Ser-<u>Asp</u>-Arg-Ala-(OH)NH₂ h140) RNH-Ile-Leu-Pro-Ile-Ala-Xaa₃-Ser-Xaa₁-Xaa₂-Thr-Glu-Val-Ser-Xaa₄-[linker]-His-  (SEQ ID NO:1587)
Arg-Lys-Lys-His-His-Gly-<u>Lys</u>-Arg-Asn-Ser-<u>Asp</u>-Arg-Ala-(OH)NH₂ h141) RNH-Ile-Leu-Pro-Ile-Ala-Ser-Xaa₃-Xaa₁-Xaa₂-Thr-Glu-Val-Ser-Xaa₄-[linker]-His-  (SEQ ID NO:1588)
Arg-Lys-Lys-His-His-Gly-<u>Lys</u>-Arg-Asn-Ser-<u>Asp</u>-Arg-Ala-(OH)NH₂

CCL28-(1–14)-[linker]-CCL28-(88–102)-cyclic(Glu94–Lys99) acid or amide h142) RNH-Ile-Leu-Pro-Ile-Ala-Ser-Ser-Cys-Cys-Thr-Glu-Val-Ser-His-[linker]-Ala-His-  (SEQ ID NO:1589)
Gln-Gly-Lys-His-<u>Glu</u>-Thr-Tyr-Gly-His-<u>Lys</u>-Thr-Pro-Tyr-(OH)NH₂ h143) RNH-Xaa₃-Leu-Pro-Ile-Ala-Ser-Ser-Xaa₁-Xaa₂-Thr-Glu-Val-Ser-His-[linker]-Ala-  (SEQ ID NO:1590)
His-Gln-Gly-Lys-His-<u>Glu</u>-Thr-Tyr-Gly-His-<u>Lys</u>-Thr-Pro-Tyr-(OH)NH₂ h144) RNH-Ile-Xaa₃-Pro-Ile-Ala-Ser-Ser-Xaa₁-Xaa₂-Thr-Glu-Val-Ser-His-[linker]-Ala-His-  (SEQ ID NO:1591)
Gln-Gly-Lys-His-<u>Glu</u>-Thr-Tyr-Gly-His-<u>Lys</u>-Thr-Pro-Tyr-(OH)NH₂ h145) RNH-Ile-Leu-Xaa₃-Ile-Ala-Ser-Ser-Xaa₁-Xaa₂-Thr-Glu-Val-Ser-His-[linker]-Ala-  (SEQ ID NO:1592)
His-Gln-Gly-Lys-His-<u>Glu</u>-Thr-Tyr-Gly-His-<u>Lys</u>-Thr-Pro-Tyr-(OH)NH₂ h146) RNH-Ile-Leu-Pro-Xaa₃-Ala-Ser-Ser-Xaa₁-Xaa₂-Thr-Glu-Val-Ser-His-[linker]-Ala-  (SEQ ID NO:1593)
His-Gln-Gly-Lys-His-<u>Glu</u>-Thr-Tyr-Gly-His-<u>Lys</u>-Thr-Pro-Tyr-(OH)NH₂ h147) RNH-Ile-Leu-Pro-Ile-Xaa₃-Ser-Ser-Xaa₁-Xaa₂-Thr-Glu-Val-Ser-His-[linker]-Ala-  (SEQ ID NO:1594)
His-Gln-Gly-Lys-His-<u>Glu</u>-Thr-Tyr-Gly-His-<u>Lys</u>-Thr-Pro-Tyr-(OH)NH₂ h148) RNH-Ile-Leu-Pro-Ile-Ala-Xaa₃-Ser-Xaa₁-Xaa₂-Thr-Glu-Val-Ser-His-[linker]-Ala-  (SEQ ID NO:1595)
His-Gln-Gly-Lys-His-<u>Glu</u>-Thr-Tyr-Gly-His-<u>Lys</u>-Thr-Pro-Tyr-(OH)NH₂ h149) RNH-Ile-Leu-Pro-Ile-Ala-Ser-Xaa₃-Xaa₁-Xaa₂-Thr-Glu-Val-Ser-His-[linker]-Ala-  (SEQ ID NO:1596)
His-Gln-Gly-Lys-His-<u>Glu</u>-Thr-Tyr-Gly-His-<u>Lys</u>-Thr-Pro-Tyr-(OH)NH₂ h150) RNH-Xaa₃-Leu-Pro-Ile-Ala-Ser-Ser-Xaa₁-Xaa₂-Xaa₄-Glu-Val-Ser-His-[linker]-Ala-  (SEQ ID NO:1597)
His-Gln-Gly-Lys-His-<u>Glu</u>-Thr-Tyr-Gly-His-<u>Lys</u>-Thr-Pro-Tyr-(OH)NH₂ h151) RNH-Ile-Xaa₃-Pro-Ile-Ala-Ser-Ser-Xaa₁-Xaa₂-Xaa₄-Glu-Val-Ser-His-[linker]-Ala-  (SEQ ID NO:1598)
His-Gln-Gly-Lys-His-<u>Glu</u>-Thr-Tyr-Gly-His-<u>Lys</u>-Thr-Pro-Tyr-(OH)NH₂ h152) RNH-Ile-Leu-Xaa₃-Ile-Ala-Ser-Ser-Xaa₁-Xaa₂-Xaa₄-Glu-Val-Ser-His-[linker]-Ala-  (SEQ ID NO:1599)
His-Gln-Gly-Lys-His-<u>Glu</u>-Thr-Tyr-Gly-His-<u>Lys</u>-Thr-Pro-Tyr-(OH)NH₂ h153) RNH-Ile-Leu-Pro-Xaa₃-Ala-Ser-Ser-Xaa₁-Xaa₂-Xaa₄-Glu-Val-Ser-His-[linker]-Ala-  (SEQ ID NO:1600)
His-Gln-Gly-Lys-His-<u>Glu</u>-Thr-Tyr-Gly-His-<u>Lys</u>-Thr-Pro-Tyr-(OH)NH₂ h154) RNH-Ile-Leu-Pro-Ile-Xaa₃-Ser-Ser-Xaa₁-Xaa₂-Xaa₄-Glu-Val-Ser-His-[linker]-Ala-  (SEQ ID NO:1601)
His-Gln-Gly-Lys-His-<u>Glu</u>-Thr-Tyr-Gly-His-<u>Lys</u>-Thr-Pro-Tyr-(OH)NH₂

-continued h155) RNH-Ile-Leu-Pro-Ile-Ala-Xaa$_3$-Ser-Xaa$_1$-Xaa$_2$-Xaa$_4$-Glu-Val-Ser-His-[linker]-Ala- (SEQ ID NO:1602)
His-Gln-Gly-Lys-His-<u>Glu</u>-Thr-Tyr-Gly-His-<u>Lys</u>-Thr-Pro-Tyr-(OH)NH$_2$ h156) RNH-Ile-Leu-Pro-Ile-Ala-Ser-Xaa$_3$-Xaa$_1$-Xaa$_2$-Xaa$_4$-Glu-Val-Ser-His-[linker]-Ala- (SEQ ID NO:1603)
His-Gln-Gly-Lys-His-<u>Glu</u>-Thr-Tyr-Gly-His-<u>Lys</u>-Thr-Pro-Tyr-(OH)NH$_2$ h157) RNH-Xaa$_3$-Leu-Pro-Ile-Ala-Ser-Ser-Xaa$_1$-Xaa$_2$-Thr-Xaa$_4$-Val-Ser-His-[linker]-Ala- (SEQ ID NO:1604)
His-Gln-Gly-Lys-His-<u>Glu</u>-Thr-Tyr-Gly-His-<u>Lys</u>-Thr-Pro-Tyr-(OH)NH$_2$ h158) RNH-Ile-Xaa$_3$-Pro-Ile-Ala-Ser-Ser-Xaa$_1$-Xaa$_2$-Thr-Xaa$_4$-Val-Ser-His-[linker]-Ala- (SEQ ID NO:1605)
His-Gln-Gly-Lys-His-<u>Glu</u>-Thr-Tyr-Gly-His-<u>Lys</u>-Thr-Pro-Tyr-(OH)NH$_2$ h159) RNH-Ile-Leu-Xaa$_3$-Ile-Ala-Ser-Ser-Xaa$_1$-Xaa$_2$-Thr-Xaa$_4$-Val-Ser-His-[linker]-Ala- (SEQ ID NO:1606)
His-Gln-Gly-Lys-His-<u>Glu</u>-Thr-Tyr-Gly-His-<u>Lys</u>-Thr-Pro-Tyr-(OH)NH$_2$ h160) RNH-Ile-Leu-Pro-Xaa$_3$-Ala-Ser-Ser-Xaa$_1$-Xaa$_2$-Thr-Xaa$_4$-Val-Ser-His-[linker]-Ala- (SEQ ID NO:1607)
His-Gln-Gly-Lys-His-<u>Glu</u>-Thr-Tyr-Gly-His-<u>Lys</u>-Thr-Pro-Tyr-(OH)NH$_2$ h161) RNH-Ile-Leu-Pro-Ile-Xaa$_3$-Ser-Ser-Xaa$_1$-Xaa$_2$-Thr-Xaa$_4$-Val-Ser-His-[linker]-Ala- (SEQ ID NO:1608)
His-Gln-Gly-Lys-His-<u>Glu</u>-Thr-Tyr-Gly-His-<u>Lys</u>-Thr-Pro-Tyr-(OH)NH$_2$ h162) RNH-Ile-Leu-Pro-Ile-Ala-Xaa$_3$-Ser-Xaa$_1$-Xaa$_2$-Thr-Xaa$_4$-Val-Ser-His-[linker]-Ala- (SEQ ID NO:1609)
His-Gln-Gly-Lys-His-<u>Glu</u>-Thr-Tyr-Gly-His-<u>Lys</u>-Thr-Pro-Tyr-(OH)NH$_2$ h163) RNH-Ile-Leu-Pro-Ile-Ala-Ser-Xaa$_3$-Xaa$_1$-Xaa$_2$-Thr-Xaa$_4$-Val-Ser-His-[linker]-Ala- (SEQ ID NO:1610)
His-Gln-Gly-Lys-His-<u>Glu</u>-Thr-Tyr-Gly-His-<u>Lys</u>-Thr-Pro-Tyr-(OH)NH$_2$ h164) RNH-Xaa$_3$-Leu-Pro-Ile-Ala-Ser-Ser-Xaa$_1$-Xaa$_2$-Thr-Glu-Xaa$_4$-Ser-His-[linker]-Ala- (SEQ ID NO:1611)
His-Gln-Gly-Lys-His-<u>Glu</u>-Thr-Tyr-Gly-His-<u>Lys</u>-Thr-Pro-Tyr-(OH)-NH$_2$ h165) RNH-Ile-Xaa$_3$-Pro-Ile-Ala-Ser-Ser-Xaa$_1$-Xaa$_2$-Thr-Glu-Xaa$_4$-Ser-His-[linker]-Ala- (SEQ ID NO:1612)
His-Gln-Gly-Lys-His-<u>Glu</u>-Thr-Tyr-Gly-His-<u>Lys</u>-Thr-Pro-Tyr-(OH)NH$_2$ h166) RNH-Ile-Leu-Xaa$_3$-Ile-Ala-Ser-Ser-Xaa$_1$-Xaa$_2$-Thr-Glu-Xaa$_4$-Ser-His-[linker]-Ala- (SEQ ID NO:1613)
His-Gln-Gly-Lys-His-<u>Glu</u>-Thr-Tyr-Gly-His-<u>Lys</u>-Thr-Pro-Tyr-(OH)NH$_2$ h167) RNH-Ile-Leu-Pro-Xaa$_3$-Ala-Ser-Ser-Xaa$_1$-Xaa$_2$-Thr-Glu-Xaa$_4$-Ser-His-[linker]-Ala- (SEQ ID NO:1614)
His-Gln-Gly-Lys-His-<u>Glu</u>-Thr-Tyr-Gly-His-<u>Lys</u>-Thr-Pro-Tyr-(OH)NH$_2$ h168) RNH-Ile-Leu-Pro-Ile-Xaa$_3$-Ser-Ser-Xaa$_1$-Xaa$_2$-Thr-Glu-Xaa$_4$-Ser-His-[linker]-Ala- (SEQ ID NO:1615)
His-Gln-Gly-Lys-His-<u>Glu</u>-Thr-Tyr-Gly-His-<u>Lys</u>-Thr-Pro-Tyr(OH)NH$_2$ h169) RNH-Ile-Leu-Pro-Ile-Ala-Xaa$_3$-Ser-Xaa$_1$-Xaa$_2$-Thr-Glu-Xaa$_4$-Ser-His-[linker]-Ala- (SEQ ID NO:1616)
His-Gln-Gly-Lys-His-<u>Glu</u>-Thr-Tyr-Gly-His-<u>Lys</u>-Thr-Pro-Tyr(OH)NH$_2$ h170) RNH-Ile-Leu-Pro-Ile-Ala-Ser-Xaa$_3$-Xaa$_1$-Xaa$_2$-Thr-Glu-Xaa$_4$-Ser-His-[linker]-Ala- (SEQ ID NO:1617)
His-Gln-Gly-Lys-His-<u>Glu</u>-Thr-Tyr-Gly-His-<u>Lys</u>-Thr-Pro-Tyr-(OH)NH$_2$ h171) RNH-Xaa$_3$-Leu-Pro-Ile-Ala-Ser-Ser-Xaa$_1$-Xaa$_2$-Thr-Glu-Val-Xaa$_4$-His-[linker]-Ala- (SEQ ID NO:1618)
His-Gln-Gly-Lys-His-<u>Glu</u>-Thr-Tyr-Gly-His-<u>Lys</u>-Thr-Pro-Tyr(OH)NH$_2$ h172) RNH-Ile-Xaa$_3$-Pro-Ile-Ala-Ser-Ser-Xaa$_1$-Xaa$_2$-Thr-Glu-Val-Xaa$_4$-His-[linker]-Ala- (SEQ ID NO:1619)
His-Gln-Gly-Lys-His-<u>Glu</u>-Thr-Tyr-Gly-His-<u>Lys</u>-Thr-Pro-Tyr-(OH)NH$_2$ h173) RNH-Ile-Leu-Xaa$_3$-Ile-Ala-Ser-Ser-Xaa$_1$-Xaa$_2$-Thr-Glu-Val-Xaa$_4$-His-[linker]-Ala- (SEQ ID NO:1620)
His-Gln-Gly-Lys-His-<u>Glu</u>-Thr-Tyr-Gly-His-<u>Lys</u>-Thr-Pro-Tyr-(OH)NH$_2$ h174) RNH-Ile-Leu-Pro-Xaa$_3$-Ala-Ser-Ser-Xaa$_1$-Xaa$_2$-Thr-Glu-Val-Xaa$_4$-His-[linker]-Ala- (SEQ ID NO:1621)
His-Gln-Gly-Lys-His-<u>Glu</u>-Thr-Tyr-Gly-His-<u>Lys</u>-Thr-Pro-Tyr-(OH)NH$_2$ h175) RNH-Ile-Leu-Pro-Ile-Xaa$_3$-Ser-Ser-Xaa$_1$-Xaa$_2$-Thr-Glu-Val-Xaa$_4$-His-[linker]-Ala- (SEQ ID NO:1622)
His-Gln-Gly-Lys-His-<u>Glu</u>-Thr-Tyr-Gly-His-<u>Lys</u>-Thr-Pro-Tyr-(OH)NH$_2$ h176) RNH-Ile-Leu-Pro-Ile-Ala-Xaa$_3$-Ser-Xaa$_1$-Xaa$_2$-Thr-Glu-Val-Xaa$_4$-His-[linker]-Ala- (SEQ ID NO:1623)
His-Gln-Gly-Lys-His-<u>Glu</u>-Thr-Tyr-Gly-His-<u>Lys</u>-Thr-Pro-Tyr-(OH)NH$_2$ h177) RNH-Ile-Leu-Pro-Ile-Ala-Ser-Xaa$_3$-Xaa$_1$-Xaa$_2$-Thr-Glu-Val-Xaa$_4$-His-[linker]-Ala- (SEQ ID NO:1624)
His-Gln-Gly-Lys-His-<u>Glu</u>-Thr-Tyr-Gly-His-<u>Lys</u>-Thr-Pro-Tyr-(OH)NH$_2$ h178) RNH-Xaa$_3$-Leu-Pro-Ile-Ala-Ser-Ser-Xaa$_1$-Xaa$_2$-Thr-Glu-Val-Ser-Xaa$_4$-[linker]-Ala- (SEQ ID NO:1625)
His-Gln-Gly-Lys-His-<u>Glu</u>-Thr-Tyr-Gly-His-<u>Lys</u>-Thr-Pro-Tyr-(OH)NH$_2$ h179) RNH-Ile-Xaa$_3$-Pro-Ile-Ala-Ser-Ser-Xaa$_1$-Xaa$_2$-Thr-Glu-Val-Ser-Xaa$_4$-[linker]-Ala- (SEQ ID NO:1626)
His-Gln-Gly-Lys-His-<u>Glu</u>-Thr-Tyr-Gly-His-<u>Lys</u>-Thr-Pro-Tyr-(OH)NH$_2$ h180) RNH-Ile-Leu-Xaa$_3$-Ile-Ala-Ser-Ser-Xaa$_1$-Xaa$_2$-Thr-Glu-Val-Ser-Xaa$_4$-[linker]-Ala- (SEQ ID NO:1627)
His-Gln-Gly-Lys-His-<u>Glu</u>-Thr-Tyr-Gly-His-<u>Lys</u>-Thr-Pro-Tyr-(OH)NH$_2$ h181) RNH-Ile-Leu-Pro-Xaa$_3$-Ala-Ser-Ser-Xaa$_1$-Xaa$_2$-Thr-Glu-Val-Ser-Xaa$_4$-[linker]-Ala- (SEQ ID NO:1628)
His-Gln-Gly-Lys-His-<u>Glu</u>-Thr-Tyr-Gly-His-<u>Lys</u>-Thr-Pro-Tyr-(OH)NH$_2$ -continued h182) RNH-Ile-Leu-Pro-Ile-Xaa₃-Ser-Ser-Xaa₁-Xaa₂-Thr-Glu-Val-Ser-Xaa₄-[linker]-Ala-   (SEQ ID NO:1629)
      His-Gln-Gly-Lys-His-<u>Glu</u>-Thr-Tyr-Gly-His-<u>Lys</u>-Thr-Pro-Tyr-(OH)NH₂ h183) RNH-Ile-Leu-Pro-Ile-Ala-Xaa₃-Ser-Xaa₁-Xaa₂-Thr-Glu-Val-Ser-Xaa₄-[linker]-Ala-   (SEQ ID NO:1630)
      His-Gln-Gly-Lys-His-<u>Glu</u>-Thr-Tyr-Gly-His-<u>Lys</u>-Thr-Pro-Tyr-(OH)NH₂ h184) RNH-Ile-Leu-Pro-Ile-Ala-Ser-Xaa₃-Xaa₁-Xaa₂-Thr-Glu-Val-Ser-Xaa₄-[linker]-Ala-   (SEQ ID NO:1631)
      His-Gln-Gly-Lys-His-<u>Glu</u>-Thr-Tyr-Gly-His-<u>Lys</u>-Thr-Pro-Tyr-(OH)NH₂

In the above structures:
R is selected from the group consisting of hydrogen, alkyl, alkenyl, alkynyl, alkylcarbonyl, arylcarbonyl, aryl, PEG (polyethyleneglycol) and any other modifying group.
$Xaa_3$ is selected from the group consisting of L-Pro, D-Pro, P*, Btd and any L- or D-natural and non-natural amino acid.
$Xaa_4$ is selected from the group consisting of P*, Btd and any L- or D-natural amino acid and any non-natural amino acid.
P* is:

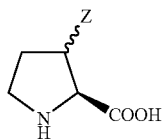

with Z=hydrogen, alkyl, alkenyl, alkynyl, alkylcarbonyl, arylcarbonyl, aryl, aryl-hydroxy, and more A wide variety of amino acid substitutions may be made in polypeptide sequences, such as lysine to glutamic acid, lysine to aspartic acid, Orn to Glu, or Orn to Asp. Moieties other than naturally occurring amino acids may also be substituted, such as Btd:

Btd* is:

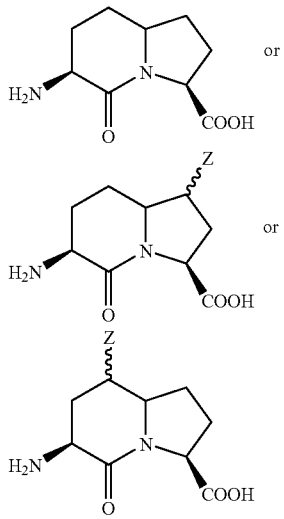

Z=hydrogen, alkyl, alkenyl, alkynyl, alkylcarbonyl, arylcarbonyl, aryl, arylhydroxy, and more
$Xaa_1$ is selected from the group consisting of any L- or D-natural amino acid and any non-natural amino acid.
$Xaa_2$ is selected from the group consisting of any L- or D-natural amino acid and any non-natural amino acid.

The linker is a bifunctional group covalently attached to the N-terminal and C-terminal portions of the analog having the structure: $H_2N-Z_4-COOH$ wherein $Z_4$ is selected from the group consisting of: (1) alkyl, alkenyl, aralkyl, and alkynyl; (2) —$(CH_2)_n$— wherein n is an integer, n=9 to 14; (3) any combination of four natural amino acids or non-natural amino acids; and (4) -(Gly)₄- (SEQ ID NO: 1640).

Compositions

The invention further provides pharmaceutical compositions containing chemokine receptor agonists or antagonists. In one embodiment, such compositions include a chemokine analog compound in a therapeutically, diagnostically or prophylactically effective amount sufficient to be used in treating diseases or disorders selected from the group consisting of autoimmune diseases, acute chronic inflammation, cancer, cardiovascular disease, infectious disease, and inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, and organ transplant rejection. In another embodiment, such compositions include a chemokine analog compound in a therapeutically or prophylactically effective amount sufficient to be used to increase the hemocrit, assist in mobilizing and recovering stem cells, stimulate the production of blood cells, assist in vaccine production, or assist in gene therapy.

An "effective amount" of a compound of the invention includes a therapeutically effective amount or a prophylatically effective amount. A "therapeutically effective amount" refers to an amount effective, at dosages and for periods of time necessary, to achieve the desired therapeutic result. The term "therapeutically effective amount" may also refer to that amount of active compound, prodrug or pharmaceutical agent that elicits a biological or medicinal response in a tissue, system, animal or human that is being sought by a researcher, veterinarian, medical doctor or other clinician in order to provide a therapeutic effect.

A "prophylactically effective amount" refers to an amount effective, at dosages and for periods of time necessary, to achieve the desired prophylactic result, such as preventing or inhibiting a cytotoxic effect of a cytotoxic agent. Typically, a prophylactic dose is used in organisms prior to or at an earlier stage of disease, so that a prophylactically effective amount may be less than a therapeutically effective amount. The term "preventing" refers to decreasing the probability that an organism contracts or develops an abnormal condition.

In particular embodiments, a preferred range for therapeutically or prophylactically effective amounts of chemokine analogs may be 0.1 nM-0.1 M, 0.1 nM-0.05 M, 0.05 nM-15 µM or 0.01 nM-10 µM. It is to be noted that dosage values may vary with the severity of the condition to be alleviated. For any particular subject, specific dosage regimens may be adjusted over time according to the individual need and the professional judgement of the person administering or supervising the administration of the compositions. Dosage ranges set forth herein are exemplary only and do not limit the dosage ranges that may be selected by medical practitioners.

The amount of active compound in the composition may vary according to factors such as the disease state, age, sex, and weight of the individual. Dosage regimens may be adjusted to provide the optimum therapeutic response. For example, a single bolus may be administered, several divided doses may be administered over time or the dose may be proportionally reduced or increased as indicated by the exigencies of the therapeutic situation. It may be advantageous to formulate parenteral compositions in dosage unit form for ease of administration and uniformity of dosage. "Dosage unit form" as used herein refers to physically discrete units suited as unitary dosages for subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic effect to be achieved, and (b) the limitations inherent in the art of compounding such an active compound for the treatment of sensitivity in individuals.

The terms "administration" or "administering" refer to a method of incorporating a compound into the cells or tissues of an animal, preferably a mammal, and still more preferably a human, in order to treat or prevent an abnormal condition. When the compound or prodrug of the invention is provided in combination with one or active agents, the terms "administration" or "administering" include sequential or concurrent introduction of the compound or prodrug with the other agent(s). For cells harbored within the organism, many techniques exist in the art to administer compounds, including (but not limited to) oral, injection, parenteral, dermal, and aerosol applications.

The term "therapeutic effect" refers to the inhibition or activation of factors causing or contributing to the abnormal condition (including a disease or disorder). A therapeutic effect relieves or prevents to some extent one or more of the symptoms of the abnormal condition. In reference to the treatment of abnormal conditions, a therapeutic effect can refer to one or more of the following: (a) an increase or decrease in the number of lymphocytic cells present at a specified location, (b) an increase or decrease in the ability of lymphocytic cells to migrate, (c) an increase or decrease in the response of lymphocytic cells to a stimulus, (d) an increase or decrease in the proliferation, growth, and/or differentiation of cells; (e) inhibition (i.e., slowing or stopping) or acceleration of cell death; (f) relieving, to some extent, one or more of the symptoms associated with an abnormal condition; (g) enhancing or inhibiting the function of the affected population of cells; (h) activating an enzyme activity present in cells associated with the abnormal condition; and (i) inhibiting an enzyme activity present in cells associated with the abnormal condition.

The term "abnormal condition" refers to a function in the cells or tissues of an organism that deviates from their normal functions in that organism and includes, but is not limited to, conditions commonly referred to as diseases or disorders. An abnormal condition can relate to cell proliferation, cell differentiation, cell survival, cell migration or movement, or the activities of enzymes within a cell. Diseases and disorders may include inflammatory disorders including rheumatoid arthritis, chronic inflammatory bowel disease, chronic inflammatory pelvic disease, multiple sclerosis, asthma, osteoarthritis, atherosclerosis, psoriasis, rhinitis, autoimmunity, organ transplant rejection, and genetic diseases.

As used herein "pharmaceutically acceptable carrier" or "excipient" includes any and all solvents, dispersion media, coatings, antibacterial and antifungal agents, isotonic and absorption delaying agents, and the like that are physiologically compatible. In one embodiment, the carrier is suitable for parenteral administration. Alternatively, the carrier can be suitable for intravenous, intraperitoneal, intramuscular, sublingual or oral administration. Pharmaceutically acceptable carriers include sterile aqueous solutions or dispersions and sterile powders for the extemporaneous preparation of sterile injectable solutions or dispersion. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions. Pharmaceutically acceptable carrier "may comprise pharmaceutically acceptable salts."

Pharmaceutical formulations for parenteral administration may include liposomes. Liposomes and emulsions are well known examples of delivery vehicles or carriers that are especially useful for hydrophobic drugs. Depending on biological stability of the therapeutic reagent, additional strategies for protein stabilization may be employed. Furthermore, one may administer the drug in a targeted drug delivery system, for example, in a liposome coated with target-specific antibody. The liposomes will bind to the target protein and be taken up selectively by the cell expressing the target protein.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, monostearate salts and gelatin. Moreover, the chemokine analogs may be administered in a time release formulation, for example in a composition which includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are patented or generally known to those skilled in the art.

Additionally, suspensions of the compounds of the invention may be prepared as appropriate oily suspensions for injection. Suitable lipophilic solvents or vehicles include fatty oils such as sesame oil; or synthetic fatty acid esters, such as ethyl oleate or triglycerides; or liposomes. Suspensions to be used for injection may also contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof. In accordance with an alternative aspect of the invention, a chemokine analog may be formulated with one or more additional compounds that enhance the solubility of the chemokine analog.

If the compounds of the invention are to be administered by inhalation, they may be conveniently delivered in the form of an aerosol spray presentation from pressurized packs or a nebuliser, together with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of gelatin, for example, for use in an inhaler may be formulated containing a powder mix of the compound and a suitable powder base such as starch or lactose.

The term "modulates" refers to altering the function or activity of a chemokine receptor by contacting it with a chemokine or chemokine analog and thus increasing or decreasing the probability that a complex forms between the receptor and a natural binding partner. A chemokine or chemokine analog preferably increases the probability that such a complex forms between the chemokine receptor and the natural binding partner, more preferably increases or decreases the probability that a complex forms between the chemokine receptor and the natural binding partner depending on the concentration of the chemokine or chemokine analog exposed to the receptor, and most preferably decreases the probability that a complex forms between the chemokine receptor and the natural binding partner depending on the concentration of the chemokine or chemokine analog exposed to the polypeptide.

The term "chemokine receptor" refers to a chemokine receptor as the term is used by one skilled in the art and also refers to any other polypeptide capable of binding a chemokine or chemokine analog.

In preferred embodiments, a modulator preferably activates the catalytic activity of a chemokine receptor, more preferably activates or inhibits the catalytic activity of a chemokine receptor depending on the concentration of the chemokine or chemokine analog exposed to the chemokine receptor, or most preferably inhibits the catalytic activity of a chemokine receptor depending on the concentration of the chemokine or chemokine analog exposed to the chemokine receptor.

The term "natural binding partner" refers to G proteins, polypeptides, lipids, small molecules, or nucleic acids that bind to chemokine receptors in cells or in the extracellular environment. The term natural binding partner includes a substrate to be acted upon by the chemokine receptor. A change in the interaction between a chemokine receptor and a natural binding partner can manifest itself as an increased or decreased probability that the interaction forms, or an increased or decreased concentration of chemokine receptor/natural binding partner complex. This can result in a decreased or increased activity of the chemokine receptor.

The terms "activated," "activating," and "activation" refer to an increase in the cellular or extracellular function of a chemokine receptor. The chemokine receptor function is preferably the interaction with a natural binding partner, and most preferably catalytic activity. The term "inhibits" refers to decreasing the cellular or extracellular activity of the chemokine receptor. The cellular or extracellular activity of a chemokine receptor is preferably the interaction with a natural binding partner, and most preferably catalytic activity.

The term "complex" refers to an assembly of at least two molecules bound to one another. A signal transduction complex often contains at least two protein molecules bound to one another. For instance, a protein tyrosine receptor protein kinase, GRB2, SOS, RAF, and RAS assemble to form a signal transduction complex in response to a mitogenic ligand. Another example is a chemokine bound to a chemokine receptor. Still another example is a G protein bound to a chemokine receptor.

The term "contacting" as used herein refers to adding together a solution or a composition comprising the chemokine or chemokine analog with a liquid medium bathing the polypeptide or cells comprising a chemokine receptor. The solution comprising the chemokine or chemokine analog may also comprise another component, such as dimethyl sulfoxide (DMSO), which facilitates the uptake of the chemokine or chemokine analog into the cells of the methods. The solution comprising the chemokine or chemokine analog may be added to the medium bathing the cells by utilizing a delivery apparatus, such as a pipette-based device or syringe-based device.

As discussed supra, compounds of the present invention may prove useful in increasing the hemocrit, mobilizing stem cells, or in assisting in vaccine production or otherwise stimulating the immune system to effectuate tumor destruction. For example, the chemokine SDF-1 has been shown to enhance platelet production (Lane et al., Blood 96:4152–59, 2000) and B-cell production (Nagasawa, T., Int. J. Hematol. 72:408–11, 2000), inter alia. Analogs of chemokines may also be useful in improving the engraftment of stem cells following transplantation (Nagasawa, 2000). Chemokine analogs of the invention may also prove useful in mobilizing stem cells (Gazitt, Y., J. Hemather Stem Cell Res 10:229–36, 2001; Hattori et al., Blood 97:3354–59, 2001). They may also prove useful in enhancing anti-tumor immunity (Nomura et al., Int. J. Cancer 91:597–606, 2001; Mach and Dranoff, Curr. Opin. Immunol. 12:571–75, 2000). Other aspects and roles of modulating chemokine function are reviewed in Schwarz and Wells (Schwarz and Wells, Nat. Rev. Drug Discov. 1:347–58, 2002). Chemokine analogs of the present invention may also prove useful in facilitating gene therapy. Glimm and colleagues reported that one chemokine, SDF-1, arrests hematopoietic stem cell cycling, thus allowing a better transfection of these cells with gene constructs for the purpose of gene therapy (Glimm H. et al., "Ex vivo treatment of proliferating human cord blood stem

EXAMPLES

The following examples illustrate, but do not limit, the present invention.

Example 1

The efficacy of chemokine analogs of the invention as chemokine receptor agonists is demonstrated through receptor binding assays. A competitive dose response for binding to a chemokine receptor by the natural binding chemokine, another chemokine, and chemokine analogs of the invention may be demonstrated by the method set forth in Daugherty et al., Methods in Molecular Biology v138 "Chemokine Protocols" edited by Proudfoot et al., Human Press, Totowa, N.J. p129–148, 2000, which is hereby incorporated by reference in its entirety, including any figures, tables and drawings.

Example 2

The efficacy of chemokine analogs of the invention as chemokine receptor agonists is demonstrated through chemotaxis assays. The effect of a native chemokine and chemokine analogs of the invention may be compared by the method set forth in Ponath et al., Methods in Molecular Biology v138 "Chemokine Protocols" edited by Proudfoot et al., Human Press, Totowa, N.J. p113–120, 2000, which is hereby incorporated by reference in its entirety, including any figures, tables and drawings.

Example 3

(IL-8)

The efficacy of IL-8 and IL-8 peptide analogs as CXCR1 and CXCR2 agonists was demonstrated through CXCR1 and CXCR2 receptor binding assays. A competitive dose response for binding to the IL-8 receptor by native IL-8 and the CXCR1 and CXCR2 agonists against $^{125}$I-IL-8 is shown in FIG. 1. THP-1 cells, a human monocytoid cell line, were preincubated with the IL-8 or IL-8 analogs for 30 min, then were assessed for $^{125}$I-IL-8 binding following 2 hr of incubation with $^{125}$I-IL-8. 10 nM $^{125}$I-IL-8 was added in the presence of IL-8 and the indicated analogs (competing ligands) at the concentrations illustrated. The results are expressed as percentages of the maximal specific binding that was determined without competing ligand. A concentration-dependent inhibition of $^{125}$I-IL-8 is illustrated, indicating the affinity of IL-8 for the receptor. The inhibition of $^{125}$I-IL-8 by IL-8 and the IL-8 analogs is indicative of CXCR1 and CXCR2 receptor binding. The compounds illustrated in the figure are as follows: IL-8, Compounds A, B, and C.

```
Compound A
H2N-Ser-Ala-Lys-Glu-Leu-Arg-Cys-Gln-Cys-Ile-Lys-Thr-Tyr-Ser-Lys-[Gly-Gly-Gly-Gly]-        (SEQ ID NO:1632)
Asn-Trp-Val-Gln-Arg-Val-Val-Glu-Lys-Phe-Leu-Lys-Arg-Ala-Glu-Asn-(OH)NH2.

Compound B
H2N-Ser-Ala-Lys-Glu-Leu-Arg-Cys-Gln-Cys-Ile-Lys-Thr-Tyr-[Gly-Gly-Gly-Gly]-Asn-Trp-         (SEQ ID NO:1633)
Val-Gln-Arg-Val-Val-Glu-Lys-Phe-Leu-Lys-Arg-Ala-Glu-Asn-(OH)NH2.

Compound C
H2N-Ser-Ala-Lys-Glu-Leu-Arg-Cys-Gln-Cys-Ile-Lys-[Gly-Gly-Gly-Gly]-Asn-Trp-Val-Gln-         (SEQ ID NO:1634)
Arg-Val-Val-Glu-Lys-Phe-Leu-Lys-Arg-Ala-Glu-Asn-(OH)NH2.
```

Example 4

(I-309)

This example illustrates the efficacy of I-309 peptide analogs in mediating intracellular calcium mobilization ($[Ca^{2+}]_i$). To illustrate that the binding of I-309 peptide analogs results in the agonistic activation of the CCR8 receptor, $[Ca^{2+}]_i$ mobilization assays were conducted, the results of which are shown in FIG. 2. To obtain the data shown in FIG. 2, Fluo-4,AM loaded human peripheral blood mononuclear cells (PBMC), at 5×10$^6$ cells/ml, were stimulated with Compounds D, E, F, G and H at the concentrations indicated. The values represent the mean+/-one S.D. As shown by the data in FIG. 2, incubation of PBMC with Compounds E, F and G resulted in the receptor-mediated induction of $[Ca^{2+}]_i$ mobilization.

```
Compound D:
H2N-Lys-Ser-Met-Gln-Val-Pro-Phe-Ser-Arg-Ala-NH2.                                           (SEQ ID NO:1635)

Compound E:
H2N-Ala-Phe-Ser-Phe-Ala-Glu-Gln-Glu-Ile-Pro-Leu-Arg-Ala-Ile-Leu-NH2.                       (SEQ ID NO:1636)

Compound F:
H2N-Ala-Phe-Ser-Phe-Ala-Glu-Gln-Glu-Ile-Pro-Leu-Arg-Ala-Ile-Leu-Cys-Tyr-Arg-Asn-Thr-       (SEQ ID NO:1637)
Ser-Ser-Ile-NH2.

Compound G:
H2N-Ala-Tyr-Arg-Asn-Thr-Ser-Ser-Ile-Cys-Ser-Asn-Glu-Gly-Leu-Ile-Phe-Lys-Leu-               (SEQ ID NO:1638)
Lys-Arg-Gly-Lys-Glu-Ala-NH2.
```

-continued

Compound H:
H$_2$N-Ala-Ala-Leu-Asp-Thr-Val-Gly-Trp-Val-Gln-Arg-His-Arg-Lys-Met-Leu-Arg-His-Cys-Pro-Ser-Lys-Arg-Lys-(OH)NH$_2$. (SEQ ID NO:1639)

Example 5

Peptides of the invention may be synthesized chemically using the Fmoc/tBu strategy on a continuous flow peptide synthesizer, as for example has been carried out using the following protocols:

Reagents (Solvents, Supports Chemicals)

Main Solvent: N,N-Dimethylformamide (DMF): certified ACS spectroanalyzed from Fisher (D131-4) M.W=73.10. The DMF is treated with activated molecular sieves, type 4A (from BDH: B54005) for at least two weeks then tested with FDNB (2,4-Dinitrofluorobenzene from Eastman).

Procedure: Mix equal volumes of FDNB solution (1 mg/ml in 95% EtOH) and DMF; Let stand 30 minutes; read the absorbance at 381 nm over a FDNB blank (0.5 ml FDNB+0.5 ml 95% EtOH). If the absorbance~0.2, the DMF is suitable to be used for the synthesis.

Deblocking Agent: 20% Piperidine (from Aldrich Chemical company, catalog No: 10,409-4) in DMF containing 0.5% Triton X100 v/v (from Sigma, catalog No: T-9284).

Activating Agents: 2-(H-benzotriazol-1yl) 1,1,3,3-tetramethyluronium tetrafluoroborate (TBTU: M.W.=321.09. from Quantum Richilieu, catalog No: R0139)/Hydroxybenzotriazole (HOBt M.W.=135.1 from Quantum Richilieu, catalog No.: R0166-100) respectively, 0.52 M in DMF and 4-Methylmorpholine (NMM; M.W.=101.15, d=0.926 from Aldrich, catalog No.: M5,655-7): 0.9 M in DMF or in the case of sensitive amino acids to racemization like Cys, we use 2,4,6-Collidine, 99% (M.W.=121.18, d=0.917, from Aldrich, catalog No: 14,238-7): 0.78M in DMF/DCM, 1/1 v/v.

Support: TentaGel R RAM (90 µm), RinK-type Fmoc (from Peptides International, catalog No.: RTS-9995-PI): 0.21 mmol/g, 0.5 g for 0.1 mmol of peptide.

Fmoc-L-amino derivative, side-chains protected with: Boc; tBu; Trt groups: with 4 fold excess (from Peptides International, Bachem, Novabiochem, Chem-Impex Inc). Glu24 and Lys24 are Allyl-protected (from Millipore/Perseptive Biosystems).

Initial Amino Loading and Peptide Synthesis Procedure

The first amino acid Asn31 and the remaining residues are double coupled at room temp. or at 45° C. automatically with 4-fold excess in each coupling. The synthesis is interrupted after residue Leu19. The peptide-bound support is removed from the synthesizer column and placed in a react-vial containing a small magnetic bar for gentle stirring.

Removal of the Allyl Groups

A solution of tetrakis(triphenylphosphine)Palladium(0) Pd(PPh3)4 (from Sigma-Aldrich, catalog No: 21,666-6); M.W.=1155.58×0.1 mmol peptide×3 fold=347 mg dissolved in 5% Acetic Acid; 2.5% NMM in CHCl3 to 0.14 M, under argon. The solution is added to the support-bound peptide previously removed from the column in a reactvial containing a small magnetic bar for gentle stirring. The mixture is flushed with argon, sealed and stirred at room temperature for 6 hours. The support-bound peptide is transferred to a filter funnel, washed with 30 ml of a solution made of 0.5% Sodium Diethyldithiocarbonate/in DMF, then DCM; DCM/DMF (1:1) and DMF. A positive Kaiser test indicate the deprotection of the amino side chain of the Lys20.

Lactam Formation:

Activating agent: 7-Azabenztriazol-1-yloxytris (pyrrolindino) phosphonium-hexafluorophosphate (PyAOP: M.W.=521.7 from PerSeptive Biosystems GmbH, catalog No: GEN076531), 1.4-fold: 0.105 mmol×1.4×521.7=76.6 mg and NMM 1.5-fold: 0.105×1.4×1.5=0.23 mmol v=0.23/0.9 M NMM solution=263 µl).

The cyclisation may be carried out in an amino acid vial at room temperature overnight (~16 hours) with gentle agitation. The completion of cyclization may be indicated by a negative kaiser test. The support-bound peptide may be poured into the column, washed with DMF and the synthesis continues to completion, with a cyclic amide bridge thereby introduced into the peptide.

Final Product Removal from the Support:

The support-bound peptide is removed from the synthesizer in to a medium filter funnel, washed with DCM to replace the non-volatile DMF and thoroughly dried under high vacuum for at least two hours, or preferably, overnight.

| Cleavage Mixture (reagent K): TFA/Phenol/Water/Thio-Anisol/EDT (82/5/5/5/2.5); 7.5 ml Support: 0.5 g resin-peptide. | |
| --- | --- |
| TFA | 6.15 ml (Biograde from Halocarbon) |
| Phenol | 0.375 ml (Aldrich) |
| Water | 0.375 ml (MillQ) |
| Thio-Anisol | 0.375 ml (Aldrich) |
| EDT | 0.187 ml (Aldrich) |
| Total | 7.5 ml |

The cleavage may be performed at room temperature for 4 hours with gentle agitation on a rocker.

Precipitation of the Peptide

The cleaved peptide solution is filtered through a filter funnel in a 50 ml round bottom flask. The support is rinsed twice with 4 ml TFA. The TFA solution is concentrated on a rotavap and added drop wise into a cold diethyl ether previously treated with activated neutral aluminum oxide to make it free of peroxide. Approximately 10-fold excess of ether are used. The beads are stored until the yield is determined and peptide characterized. The precipitate is collected at room temperature in screw capped 50 ml polypropylene vial by centrifugation at 2K rpm using a top bench centrifuge (4 minutes run time). The pellet is washed 3× with cold ether, centrifuged and dried with a flow of argon. The precipitate is dissolved in 20% acetonitrile, 0.1% TFA and lyophilized.

Crude Product Characterization:

The product is characterized by analytical HPLC.
Experimental conditions: Column: Vydac 218TP54: C18 reversed-phase 5 µm, 4.6 mm ID×150 mm L.
Eluants: 0.1% TFA/H$_2$O (solvent A); 0.1% TFA/acetonitrile (solvent B).

Elution Conditions: 20–50% B (40 min); 60–90% B (5 min); 90–20% B (5 min); 20% B (10 min). At 1.0 ml/min and A214 nm=0.5 absorbance unit full scale.

Sample Preparation:

An aliquot of the product is weighed and dissolved in 20% acetonitrile 0.1% TFA at a concentration of 2 mg/ml. The solution is microfuged and 20 µl is applied onto the column. The main peak or the major peaks are collected, SpeedVac dried and molecular weight determined by mass spectrometry.

Structure of some of the compounds used in this study is shown below.

material to be removed was specifically recited. In addition, where features or aspects of an invention are described in terms of the Markush group, those schooled in the art will recognize that the invention is also thereby described in terms of any individual member or subgroup of members of the Markush group. Further, when a reference to an aspect of the invention lists a range of individual members, as for example, 'SEQ ID NO:9 to SEQ ID NO:162, inclusive,' it is intended to be equivalent to listing every member of the list individually, and additionally it should be understood that every individual member may be excluded or included in the claim individually.

```
Compound A or a19 (SEQ ID NO:27), wherein R = H, Xaa₁ = Cys,
Xaa₂ = Cys, [linker] = 4 * Gly):
H₂N-Ser-Ala-Lys-Glu-Leu-Arg-Cys-Gln-Cys-Ile-Lys-Thr-Tyr-Ser-Lys-[Gly-Gly-Gly-Gly]-      (SEQ ID NO:1632)
Asn-Trp-Val-Gln-Arg-Val-Val-Glu-Lys-Phe-Leu-Lys-Arg-Ala-Glu-Asn-(OH)NH₂.

Compound B or a49 (SEQ ID NO:56), wherein R = H, Xaa₁ = Cys,
Xaa₂ = Cys, [linker] = 4 * Gly):
H₂N-Ser-Ala-Lys-Glu-Leu-Arg-Cys-Gln-Cys-Ile-Lys-Thr-Tyr-[Gly-Gly-Gly-Gly]-Asn-Trp-      (SEQ ID NO:1633)
Val-Gln-Arg-Val-Val-Glu-Lys-Phe-Leu-Lys-Arg-Ala-Glu-Asn-(OH)NH₂.

Compound C or a70 (SEQ ID NO:77), wherein R = H, Xaa₁ = Cys,
Xaa₂ = Cys, [linker] = 4 * Gly):
H₂N-Ser-Ala-Lys-Glu-Leu-Arg-Cys-Gln-Cys-Ile-Lys-[Gly-Gly-Gly-Gly]-Asn-Trp-Val-Gln-      (SEQ ID NO:1634)
Arg-Val-Val-Glu-Lys-Phe-Leu-Lys-Arg-Ala-Glu-Asn-(OH)NH₂.

Compound D or e1 (SEQ ID NO:972), wherein R = H):
H₂N-Lys-Ser-Met-Gln-Val-Pro-Phe-Ser-Arg-Ala-NH₂.                                         (SEQ ID NO:1635)

Compound E or e2 (SEQ ID NO:973), wherein R = H)
H₂N-Ala-Phe-Ser-Phe-Ala-Glu-Gln-Glu-Ile-Pro-Leu-Arg-Ala-Ile-Leu-NH₂.                     (SEQ ID NO:1636)

Compound F or e3 (SEQ ID NO:974), wherein R = H):
H₂N-Ala-Phe-Ser-Phe-Ala-Glu-Gln-Glu-Ile-Pro-Leu-Arg-Ala-Ile-Leu-Cys-Tyr-Arg-Asn-Thr-    (SEQ ID NO:1637)
Ser-Ser-Ile-NH₂.

Compound G or e4 (SEQ ID NO:975), wherein R = H):
H₂N-Ala-Tyr-Arg-Asn-Thr-Ser-Ser-Ile-Cys-Ser-Asn-Glu-Gly-Leu-Ile-Phe-Lys-Leu-Lys-Arg-    (SEQ ID NO:1638)
Gly-Lys-Glu-Ala-NH₂.

Compound H or e17 (SEQ ID NO:988), wherein R = H):
H₂N-Ala-Ala-Leu-Asp-Thr-Val-Gly-Trp-Val-Gln-Arg-His-Arg-Lys-Met-Leu-Arg-His-Cys-         (SEQ ID NO:1639)
Pro-Ser-Lys-Arg-Lys-(OH)NH₂.
```

The invention illustratively described herein can suitably be practiced in the absence of any element or elements, limitation or limitations that is not specifically disclosed herein, Thus, for example, the terms "comprising," "including," "containing," etc., shall be read expansively and without limitation. Additionally, the terms and expressions employed herein have been used as terms of description and not of limitation, and there is no intention in the use of such terms and expressions of excluding any equivalent of the invention shown or portion thereof, but it is recognized that various modifications are possible within the scope of the invention claimed. Thus, it should be understood that although the present invention has been specifically disclosed by preferred embodiments and optional features, modifications and variations of the inventions embodied herein disclosed can be readily made by those skilled in the art, and that such modifications and variations are considered to be within the scope of the inventions disclosed herein. The inventions have been described broadly and generically herein. Each of the narrower species and subgeneric groupings falling within the generic disclosure also form the part of these inventions. This includes within the generic description of each of the inventions a proviso or negative limitation that will allow removing any subject matter from the genus, regardless or whether or not the The steps depicted and/or used in methods herein may be performed in a different order than as depicted and/or stated. The steps are merely exemplary of the order these steps may occur. The steps may occur in any order that is desired such that it still performs the goals of the claimed invention.

From the description of the invention herein, it is manifest that various equivalents can be used to implement the concepts of the present invention without departing from its scope. Moreover, while the invention has been described with specific reference to certain embodiments, a person of ordinary skill in the art would recognize that changes can be made in form and detail without departing from the spirit and the scope of the invention. The described embodiments are considered in all respects as illustrative and not restrictive. It should also be understood that the invention is not limited to the particular embodiments described herein, but is capable of many equivalents, rearrangements, modifications, and substitution without departing from the scope of the invention. Thus, additional embodiments are within the scope of the invention and within the following claims.

Further, all patents and publications described herein are hereby incorporated by reference to the same extent as if each individual patent or publication was specifically and individually indicated to be incorporated by reference.

SEQUENCE LISTING (1640 sequences)

SEQ ID NO: 1 - protein, 77 aa, Artificial Sequence
  Description of Artificial Sequence: Synthetic peptide
AVIPRSAKELRCQCIKTYSKPFHPKFIKELRVIESGPHCANTEIIVKLSDGRELCLDPKENWVQRVVEKFLKRAENS

SEQ ID NO: 2 - protein, 78 aa, Artificial Sequence
  Description of Artificial Sequence: Synthetic peptide
VPLSRTVRCTCISISNQPVNPPRSLEKLEIIPASQFCPRVEIIATMKKKGEKRCLNPESKAIKNLLKAVSKEMSKRSP

SEQ ID NO: 3 - protein, 69 aa, Artificial Sequence
  Description of Artificial Sequence: Synthetic peptide
SLAADTPTACCFSYTSRQIPQNFIADYFETSSQCSKPGVIFLTKRSRQVCADPSEEWVQKYVSDLELSA

SEQ ID NO: 4 - protein, 68 aa, Artificial Sequence
  Description of Artificial Sequence: Synthetic peptide
SPYSSDTTPCCFAYIARPLPRAHIKEYFYTSGKCSNPAVVFVTRKNRQVCANPEKKWVREYINSLEMS

SEQ ID NO: 5 - protein, 73 aa, Artificial Sequence
  Description of Artificial Sequence: Synthetic peptide
KSMQVPFSRCCFSFAEQEIPLRAILCYRNTSSICSNEGLIFKLKRGKEACALDTVGWVQRHRKMLRHCPSKRK

SEQ ID NO: 6 - skipped

SEQ ID NO: 7 - protein, 76 aa, Artificial Sequence
  Description of Artificial Sequence: Synthetic peptide
QPDAINAPVTCCYNFTNRKISVQRLASYRRITSSKCPKEAVIFKTIVAKEICADPKQKWVQDSMDHLDKQTQTPKT

SEQ ID NO: 8 - protein, 105 aa, Artificial Sequence
  Description of Artificial Sequence: Synthetic peptide
ILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 9 - protein, 15 aa, Artificial Sequence
  Description of Artificial Sequence: Synthetic peptide
  c-term may be amidated
SAKELRCQCIKTYSK

SEQ ID NO: 10 - protein, 15 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAKELRXQXIKTYSK

SEQ ID NO: 11 - protein, 15 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
XAKELRXQXIKTYSK

SEQ ID NO: 12 - protein, 15 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SXKELRXQXIKTYSK

SEQ ID NO: 13 - protein, 15 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAXELRXQXIKTYSK

SEQ ID NO: 14 - protein, 13 aa, Artificial Sequence
  Description of Artificial Sequence: Synthetic peptide
  c-term may be amidated
SAKELRCQCIKTY

SEQ ID NO: 15 - protein, 13 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAKELRXQXIKTY

SEQ ID NO: 16 - protein, 13 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
XAKELRXQXIKTY

SEQ ID NO: 17 - protein, 13 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SXKELRXQXIKTY

SEQ ID NO: 18 - protein, 13 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAXELRXQXIKTY

SEQ ID NO: 19 - protein, 11 aa, Artificial Sequence
  Description of Artificial Sequence: Synthetic peptide
  c-term may be amidated
SAKELRCQCIK

SEQ ID NO: 20 - protein, 11 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAKELRXQXIK

SEQ ID NO: 21 - protein, 11 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
XAKELRXQXIK

SEQ ID NO: 22 - protein, 11 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SXKELRXQXIK

SEQ ID NO: 23 - protein, 11 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  c-term may be amidated
SAXELRXQXIK

SEQ ID NO: 24 - protein, 25 aa, Artificial Sequence
  Description of Artificial Sequence: Synthetic peptide
  c-term may be amidated
AIKTYSKPFHPKFIKELRVIESGPH

SEQ ID NO: 25 - protein, 16 aa, Artificial Sequence
  Description of Artificial Sequence: Synthetic peptide
  c-term may be amidated
AANTEIIVKLSDGREL

SEQ ID NO: 26 - protein, 22 aa, Artificial Sequence
  Description of Artificial Sequence: Synthetic peptide
  c-term may be amidated
LDPKENWVQRVVEKFLKRAENS

SEQ ID NO: 27 - protein, 35 aa, Artificial Sequence
  Description of Artificial Sequence: Synthetic peptide
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRCQCIKTYSKXXXXNWVQRVVEKFLKRAEN

SEQ ID NO: 28 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTYSKXXXXNWVQRVVEKFLKRAEN

SEQ ID NO: 29 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTYSKXXXXNWVQRVVEKFLKRAEN

SEQ ID NO: 30 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTYSKXXXXNWVQRVVEKFLKRAEN

SEQ ID NO: 31 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTYSKXXXXNWVQRVVEKFLKRAEN

SEQ ID NO: 32 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXXKTYSKXXXXNWVQRVVEKFLKRAEN

SEQ ID NO: 33 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXXKTYSKXXXXNWVQRVVEKFLKRAEN

SEQ ID NO: 34 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXXKTYSKXXXXNWVQRVVEKFLKRAEN

SEQ ID NO: 35 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXXKTYSKXXXXNWVQRVVEKFLKRAEN

SEQ ID NO: 36 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIXTYSKXXXXNWVQRVVEKFLKRAEN

SEQ ID NO: 37 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIXTYSKXXXXNWVQRVVEKFLKRAEN

SEQ ID NO: 38 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIXTYSKXXXXNWVQRVVEKFLKRAEN

SEQ ID NO: 39 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIXTYSKXXXXNWVQRVVEKFLKRAEN

SEQ ID NO: 40 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKXYSKXXXXNWVQRVVEKFLKRAEN

SEQ ID NO: 41 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKXYSKXXXXNWVQRVVEKFLKRAEN

SEQ ID NO: 42 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKXYSKXXXXNWVQRVVEKFLKRAEN

SEQ ID NO: 43 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKXYSKXXXXNWVQRVVEKFLKRAEN

SEQ ID NO: 44 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTXSKXXXXNWVQRVVEKFLKRAEN

SEQ ID NO: 45 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTXSKXXXXNWVQRVVEKFLKRAEN

SEQ ID NO: 46 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTXSKXXXXNWVQRVVEKFLKRAEN

SEQ ID NO: 47 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTXSKXXXXNWVQRVVEKFLKRAEN

SEQ ID NO: 48 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTYXKXXXXNWVQRVVEKFLKRAEN

SEQ ID NO: 49 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTYXKXXXXNWVQRVVEKFLKRAEN

SEQ ID NO: 50 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTYXKXXXXNWVQRVVEKFLKRAEN

SEQ ID NO: 51 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTYXKXXXXNWVQRVVEKFLKRAEN

SEQ ID NO: 52 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTYSXXXXXNWVQRVVEKFLKRAEN

SEQ ID NO: 53 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTYSXXXXXNWVQRVVEKFLKRAEN

SEQ ID NO: 54 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTYSXXXXXNWVQRVVEKFLKRAEN

SEQ ID NO: 55 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTYSXXXXXNWVQRVVEKFLKRAEN

SEQ ID NO: 56 - protein, 33 aa, Artificial Sequence
  Description of Artificial Sequence: Synthetic peptide
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRCQCIKTYXXXXNWVQRVVEKFLKRAEN

SEQ ID NO: 57 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTYXXXXNWVQRVVEKFLKRAEN

SEQ ID NO: 58 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTYXXXXNWVQRVVEKFLKRAEN

SEQ ID NO: 59 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTYXXXXNWVQRVVEKFLKRAEN

SEQ ID NO: 60 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTYXXXXNWVQRVVEKFLKRAEN

SEQ ID NO: 61 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRXQXXKTYXXXXNWVQRVVEKFLKRAEN

SEQ ID NO: 62 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
XAKELRXQXXKTYXXXXNWVQRVVEKFLKRAEN

SEQ ID NO: 63 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SXKELRXQXXKTYXXXXNWVQRVVEKFLKRAEN

SEQ ID NO: 64 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAXELRXQXXKTYXXXXNWVQRVVEKFLKRAEN

SEQ ID NO: 65 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRXQXIXTYXXXXNWVQRVVEKFLKRAEN

SEQ ID NO: 66 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
XAKELRXQXIXTYXXXXNWVQRVVEKFLKRAEN

SEQ ID NO: 67 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SXKELRXQXIXTYXXXXNWVQRVVEKFLKRAEN

SEQ ID NO: 68 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAXELRXQXIXTYXXXXNWVQRVVEKFLKRAEN

SEQ ID NO: 69 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKXYXXXXNWVQRVVEKFLKRAEN

SEQ ID NO: 70 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKXYXXXXNWVQRVVEKFLKRAEN

SEQ ID NO: 71 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKXYXXXXNWVQRVVEKFLKRAEN

SEQ ID NO: 72 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKXYXXXXNWVQRVVEKFLKRAEN

SEQ ID NO: 73 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKTXXXXXNWVQRVVEKFLKRAEN

SEQ ID NO: 74 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKTXXXXXNWVQRVVEKFLKRAEN

SEQ ID NO: 75 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKTXXXXXNWVQRVVEKFLKRAEN

SEQ ID NO: 76 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKTXXXXXNWVQRVVEKFLKRAEN

SEQ ID NO: 77 - protein, 31 aa, Artificial Sequence
  Description of Artificial Sequence: Synthetic peptide
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAKELRCQCIKXXXXNWVQRVVEKFLKRAEN

SEQ ID NO: 78 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAKELRXQXIKXXXXNWVQRVVEKFLKRAEN

SEQ ID NO: 79 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
XAKELRXQXIKXXXXNWVQRVVEKFLKRAEN

SEQ ID NO: 80 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SXKELRXQXIKXXXXNWVQRVVEKFLKRAEN

SEQ ID NO: 81 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAXELRXQXIKXXXXNWVQRVVEKFLKRAEN

SEQ ID NO: 82 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAKELRXQXXKXXXXNWVQRVVEKFLKRAEN

SEQ ID NO: 83 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
XAKELRXQXXKXXXXNWVQRVVEKFLKRAEN

SEQ ID NO: 84 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SXKELRXQXXKXXXXNWVQRVVEKFLKRAEN

SEQ ID NO: 85 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAXELRXQXXKXXXXNWVQRVVEKFLKRAEN

SEQ ID NO: 86 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAKELRXQXIXXXXXNWVQRVVEKFLKRAEN

SEQ ID NO: 87 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
XAKELRXQXIXXXXXNWVQRVVEKFLKRAEN

SEQ ID NO: 88 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SXKELRXQXIXXXXXNWVQRVVEKFLKRAEN

SEQ ID NO: 89 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated
SAXELRXQXIXXXXXNWVQRVVEKFLKRAEN

SEQ ID NO: 90 - protein, 13 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  c-term may be amidated
XAKELRXQXIKTX

SEQ ID NO: 91 - protein, 13 aa, Artificial Sequence
  Description of Artificial Sequence: Synthetic peptide
  MOD_RES (1)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  c-term may be amidated
XXKELRXQXIKTX

SEQ ID NO: 92 - protein, 13 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  c-term may be amidated
XAXELRXQXIKTX

SEQ ID NO: 93 - protein, 26 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (26)..(26): Any L- or D-natural amino acid and any non-natural amino acid; see  specification as filed for detail ed description of substitutions, R-groups  and preferred embodiments
  c-term may be amidated
XIKTYSKPFHPKFIKELRVIESGPHX

SEQ ID NO: 94 - protein, 17 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  c-term may be amidated
XANTEIIVKLSDGRELX

SEQ ID NO: 95 - protein, 23 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (23)..(23): Any L- or D-natural amino acid and any non-natural amino acid; see  specification as filed for detail ed description of substitutions, R-groups  and preferred embodiments
  c-term may be amidated
XLDPKENWVQRVVEKFLKRAENX

SEQ ID NO: 96 - protein, 23 aa, Artificial Sequence
  Description of Artificial Sequence: Synthetic peptide
  c-term may be amidated
ALDPKENWVQRVVEKFLKRAENS

SEQ ID NO: 97 - protein, 23 aa, Artificial Sequence
  Description of Artificial Sequence: Synthetic peptide
  c-term may be amidated
ALDPKENWVQRVVEKFLKRAENS

SEQ ID NO: 98 - skipped

SEQ ID NO: 99 - protein, 23 aa, Artificial Sequence
  Description of Artificial Sequence: Synthetic peptide
  c-term may be amidated
ALDPKENWVQRVVEKFLKRAENS

SEQ ID NO: 100 - protein, 35 aa, Artificial Sequence; identical to SEQ ID NO: 27
  Description of Artificial Sequence: Synthetic peptide
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 101 - protein, 35 aa, Artificial Sequence; identical to SEQ ID NO: 28
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 102 - protein, 35 aa, Artificial Sequence; identical to SEQ ID NO: 29
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 103 - protein, 35 aa, Artificial Sequence; identical to SEQ ID NO: 30
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 104 - protein, 35 aa, Artificial Sequence; identical to SEQ ID NO: 31
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 105 - protein, 35 aa, Artificial Sequence; identical to SEQ ID NO: 32
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 106 - protein, 35 aa, Artificial Sequence; identical to SEQ ID NO: 33
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 107 - protein, 35 aa, Artificial Sequence; identical to SEQ ID NO: 34
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 108 - protein, 35 aa, Artificial Sequence; identical to SEQ ID NO: 35
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 109 - protein, 35 aa, Artificial Sequence; identical to SEQ ID NO: 36
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 110 - protein, 35 aa, Artificial Sequence; identical to SEQ ID NO: 37
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 111 - protein, 35 aa, Artificial Sequence; identical to SEQ ID NO: 38
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 112 - protein, 35 aa, Artificial Sequence; identical to SEQ ID NO: 39
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 113 - protein, 35 aa, Artificial Sequence; identical to SEQ ID NO: 40
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 114 - protein, 35 aa, Artificial Sequence; identical to SEQ ID NO: 41
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 115 - protein, 35 aa, Artificial Sequence; identical to SEQ ID NO: 42
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 116 - protein, 35 aa, Artificial Sequence; identical to SEQ ID NO: 43
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 117 - protein, 35 aa, Artificial Sequence; identical to SEQ ID NO: 44
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 118 - protein, 35 aa, Artificial Sequence; identical to SEQ ID NO: 45
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 119 - protein, 35 aa, Artificial Sequence; identical to SEQ ID NO: 46
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 120 - protein, 35 aa, Artificial Sequence; identical to SEQ ID NO: 47
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 121 - protein, 35 aa, Artificial Sequence; identical to SEQ ID NO: 48
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 122 - protein, 35 aa, Artificial Sequence; identical to SEQ ID NO: 49
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 123 - protein, 35 aa, Artificial Sequence; identical to SEQ ID NO: 50
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 124 - protein, 35 aa, Artificial Sequence; identical to SEQ ID NO: 51
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 125 - protein, 35 aa, Artificial Sequence; identical to SEQ ID NO: 52
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 126 - protein, 35 aa, Artificial Sequence; identical to SEQ ID NO: 53
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 127 - protein, 35 aa, Artificial Sequence; identical to SEQ ID NO: 54
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 128 - protein, 35 aa, Artificial Sequence; identical to SEQ ID NO: 55
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (16)..(19): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 129 - protein, 33 aa, Artificial Sequence; identical to SEQ ID NO: 56
  Description of Artificial Sequence: Synthetic peptide
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 130 - protein, 33 aa, Artificial Sequence; identical to SEQ ID NO: 57
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 131 - protein, 33 aa, Artificial Sequence; identical to SEQ ID NO: 58
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 132 - protein, 33 aa, Artificial Sequence; identical to SEQ ID NO: 59
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 133 - protein, 33 aa, Artificial Sequence; identical to SEQ ID NO: 60
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 134 - protein, 33 aa, Artificial Sequence; identical to SEQ ID NO: 61
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 135 - protein, 33 aa, Artificial Sequence; identical to SEQ ID NO: 62
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 136 - protein, 33 aa, Artificial Sequence; identical to SEQ ID NO: 63
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 137 - protein, 33 aa, Artificial Sequence; identical to SEQ ID NO: 64
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 138 - protein, 33 aa, Artificial Sequence; identical to SEQ ID NO: 65
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 139 - protein, 33 aa, Artificial Sequence; identical to SEQ ID NO: 66
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 140 - protein, 33 aa, Artificial Sequence; identical to SEQ ID NO: 67
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 141 - protein, 33 aa, Artificial Sequence; identical to SEQ ID NO: 68
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 142 - protein, 33 aa, Artificial Sequence; identical to SEQ ID NO: 69
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 143 - protein, 33 aa, Artificial Sequence; identical to SEQ ID NO: 70
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 144 - protein, 33 aa, Artificial Sequence; identical to SEQ ID NO: 71
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 145 - protein, 33 aa, Artificial Sequence; identical to SEQ ID NO: 72
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 146 - protein, 33 aa, Artificial Sequence; identical to SEQ ID NO: 73
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 147 - protein, 33 aa, Artificial Sequence; identical to SEQ ID NO: 74
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 148 - protein, 33 aa, Artificial Sequence; identical to SEQ ID NO: 75
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 149 - protein, 33 aa, Artificial Sequence; identical to SEQ ID NO: 76
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (14)..(17): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 150 - protein, 31 aa, Artificial Sequence; identical to SEQ ID NO: 77
  Description of Artificial Sequence: Synthetic peptide
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 151 - protein, 31 aa, Artificial Sequence; identical to SEQ ID NO: 78
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 152 - protein, 31 aa, Artificial Sequence; identical to SEQ ID NO: 79
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 153 - protein, 31 aa, Artificial Sequence; identical to SEQ ID NO: 80
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 154 - protein, 31 aa, Artificial Sequence; identical to SEQ ID NO: 81
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 155 - protein, 31 aa, Artificial Sequence; identical to SEQ ID NO: 82
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 156 - protein, 31 aa, Artificial Sequence; identical to SEQ ID NO: 83
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 157 - protein, 31 aa, Artificial Sequence; identical to SEQ ID NO: 84
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 158 - protein, 31 aa, Artificial Sequence; identical to SEQ ID NO: 85
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 159 - protein, 31 aa, Artificial Sequence; identical to SEQ ID NO: 86
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 160 - protein, 31 aa, Artificial Sequence; identical to SEQ ID NO: 87
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 161 - protein, 31 aa, Artificial Sequence; identical to SEQ ID NO: 88
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 162 - protein, 31 aa, Artificial Sequence; identical to SEQ ID NO: 89
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (12)..(15): Any L- or D-natural or non-natural amino acid, and this range may  encompass 1 or 4 residues; see spe cification as filed for detailed  description of substitutions, R-groups and preferred embodi
  c-term may be amidated

SEQ ID NO: 163 - protein, 14 aa, Artificial Sequence
  Description of Artificial Sequence: Synthetic peptide
  c-term may be amidated
VPLSRTVRCTCISI

SEQ ID NO: 164 - protein, 14 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPXSRTVRXTXISI

SEQ ID NO: 165 - protein, 14 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLXRTVRXTXISI

SEQ ID NO: 166 - protein, 14 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSXTVRXTXISI

SEQ ID NO: 167 - protein, 14 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRXVRXTXISI

SEQ ID NO: 168 - protein, 14 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRTXRXTXISI

SEQ ID NO: 169 - protein, 15 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  c-term may be amidated
VPLSRTVRXXTXISI

SEQ ID NO: 170 - protein, 17 aa, Artificial Sequence
  Description of Artificial Sequence: Synthetic peptide
  c-term may be amidated
VPLSRTVRCTCISISNQ

SEQ ID NO: 171 - protein, 17 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPXSRTVRXTXISISNQ

SEQ ID NO: 172 - protein, 17 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLXRTVRXTXISISNQ

SEQ ID NO: 173 - protein, 17 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSXTVRXTXISISNQ

SEQ ID NO: 174 - protein, 17 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRXVRXTXISISNQ

SEQ ID NO: 175 - protein, 17 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRTXRXTXISISNQ

SEQ ID NO: 176 - protein, 18 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  c-term may be amidated
VPLSRTVRXXTXISISNQ

SEQ ID NO: 177 - protein, 25 aa, Artificial Sequence
  Description of Artificial Sequence: Synthetic peptide
  c-term may be amidated
AISISNQPVNPRSLEKLEIIPASQF

SEQ ID NO: 178 - protein, 35 aa, Artificial Sequence
  Description of Artificial Sequence: Synthetic peptide
  c-term may be amidated
VPLSRTVRCTCISISNQPVNPRSLEKLEIIPASQF

SEQ ID NO: 179 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
XPLSRTVRXTXISISNQPVNPRSLEKLEIIPASQF

SEQ ID NO: 180 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VXLSRTVRXTXISISNQPVNPRSLEKLEIIPASQF

SEQ ID NO: 181 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPXSRTVRXTXISISNQPVNPRSLEKLEIIPASQF

SEQ ID NO: 182 - protein, 35 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLXRTVRXTXISISNQPVNPRSLEKLEIIPASQF

SEQ ID NO: 183 - protein, 35 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSXTVRXTXISISNQPVNPRSLEKLEIIPASQF

SEQ ID NO: 184 - protein, 35 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRXVRXTXISISNQPVNPRSLEKLEIIPASQF

SEQ ID NO: 185 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRTXRXTXISISNQPVNPRSLEKLEIIPASQF

SEQ ID NO: 186 - protein, 35 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  c-term may be amidated
VPLSRTVXXTXISISNQPVNPRSLEKLEIIPASQF

SEQ ID NO: 187 - protein, 24 aa, Artificial Sequence
  Description of Artificial Sequence: Synthetic peptide
  c-term may be amidated
LNPESKAIKNLLKAVSKEMSKRSP

SEQ ID NO: 188 - protein, 31 aa, Artificial Sequence
  Description of Artificial Sequence: Synthetic peptide
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISIXXXXLKAVSKEMSKRSP

SEQ ID NO: 189 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXISIXXXXLKAVSKEMSKRSP

SEQ ID NO: 190 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXISIXXXXLKAVSKEMSKRSP

SEQ ID NO: 191 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXISIXXXXLKAVSKEMSKRSP

SEQ ID NO: 192 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXISIXXXXLKAVSKEMSKRSP

SEQ ID NO: 193 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXISIXXXXLKAVSKEMSKRSP

SEQ ID NO: 194 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXISIXXXXLKAVSKEMSKRSP

SEQ ID NO: 195 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXISIXXXXLKAVSKEMSKRSP

SEQ ID NO: 196 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXISIXXXXLKAVSKEMSKRSP

SEQ ID NO: 197 - protein, 31 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCXSIXXXXLKAVSKEMSKRSP

SEQ ID NO: 198 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXXSIXXXXLKAVSKEMSKRSP

SEQ ID NO: 199 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXXSIXXXXLKAVSKEMSKRSP

SEQ ID NO: 200 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXXSIXXXXLKAVSKEMSKRSP

SEQ ID NO: 201 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXXSIXXXXLKAVSKEMSKRSP

SEQ ID NO: 202 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXXSIXXXXLKAVSKEMSKRSP

SEQ ID NO: 203 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXXSIXXXXLKAVSKEMSKRSP

SEQ ID NO: 204 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXXSIXXXXLKAVSKEMSKRSP

SEQ ID NO: 205 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXXSIXXXXLKAVSKEMSKRSP

SEQ ID NO: 206 - protein, 31 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCIXIXXXXLKAVSKEMSKRSP

SEQ ID NO: 207 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXIXIXXXXLKAVSKEMSKRSP

SEQ ID NO: 208 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXIXIXXXXLKAVSKEMSKRSP

SEQ ID NO: 209 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXIXIXXXXLKAVSKEMSKRSP

SEQ ID NO: 210 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXIXIXXXXLKAVSKEMSKRSP

SEQ ID NO: 211 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXIXIXXXXLKAVSKEMSKRSP

SEQ ID NO: 212 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXIXIXXXXLKAVSKEMSKRSP

SEQ ID NO: 213 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXIXIXXXXLKAVSKEMSKRSP

SEQ ID NO: 214 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXIXIXXXXLKAVSKEMSKRSP

SEQ ID NO: 215 - protein, 31 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISXXXXXLKAVSKEMSKRSP

SEQ ID NO: 216 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXISXXXXXLKAVSKEMSKRSP

SEQ ID NO: 217 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXISXXXXXLKAVSKEMSKRSP

SEQ ID NO: 218 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXISXXXXXLKAVSKEMSKRSP

SEQ ID NO: 219 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXISXXXXXLKAVSKEMSKRSP

SEQ ID NO: 220 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXISXXXXXLKAVSKEMSKRSP

SEQ ID NO: 221 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXISXXXXXLKAVSKEMSKRSP

SEQ ID NO: 222 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXISXXXXXLKAVSKEMSKRSP

SEQ ID NO: 223 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXISXXXXXLKAVSKEMSKRSP

SEQ ID NO: 224 - protein, 31 aa, Artificial Sequence
  Description of Artificial Sequence: Synthetic peptide
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISIXXXXLNPESKAIKNLLK

SEQ ID NO: 225 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXISIXXXXLNPESKAIKNLLK

SEQ ID NO: 226 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXISIXXXXLNPESKAIKNLLK

SEQ ID NO: 227 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXISIXXXXLNPESKAIKNLLK

SEQ ID NO: 228 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXISIXXXXLNPESKAIKNLLK

SEQ ID NO: 229 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXISIXXXXLNPESKAIKNLLK

SEQ ID NO: 230 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXISIXXXXLNPESKAIKNLLK

SEQ ID NO: 231 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXISIXXXXLNPESKAIKNLLK

SEQ ID NO: 232 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXISIXXXXLNPESKAIKNLLK

SEQ ID NO: 233 - protein, 31 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCXSIXXXXLNPESKAIKNLLK

SEQ ID NO: 234 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXXSIXXXXLNPESKAIKNLLK

SEQ ID NO: 235 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXXSIXXXXLNPESKAIKNLLK

SEQ ID NO: 236 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXXSIXXXXLNPESKAIKNLLK

SEQ ID NO: 237 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXXSIXXXXLNPESKAIKNLLK

SEQ ID NO: 238 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXXSIXXXXLNPESKAIKNLLK

SEQ ID NO: 239 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXXSIXXXXLNPESKAIKNLLK

SEQ ID NO: 240 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXXSIXXXXLNPESKAIKNLLK

SEQ ID NO: 241 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXXSIXXXXLNPESKAIKNLLK

SEQ ID NO: 242 - protein, 31 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCIXIXXXXLNPESKAIKNLLK

SEQ ID NO: 243 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXIXIXXXXLNPESKAIKNLLK

SEQ ID NO: 244 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXIXIXXXXLNPESKAIKNLLK

SEQ ID NO: 245 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXIXIXXXXLNPESKAIKNLLK

SEQ ID NO: 246 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXIXIXXXXLNPESKAIKNLLK

SEQ ID NO: 247 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXIXIXXXXLNPESKAIKNLLK

SEQ ID NO: 248 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXIXIXXXXLNPESKAIKNLLK

SEQ ID NO: 249 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXIXIXXXXLNPESKAIKNLLK

SEQ ID NO: 250 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXIXIXXXXLNPESKAIKNLLK

SEQ ID NO: 251 - protein, 31 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISXXXXXLNPESKAIKNLLK

SEQ ID NO: 252 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXISXXXXXLNPESKAIKNLLK

SEQ ID NO: 253 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXISXXXXXLNPESKAIKNLLK

SEQ ID NO: 254 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXISXXXXXLNPESKAIKNLLK

SEQ ID NO: 255 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXISXXXXXLNPESKAIKNLLK

SEQ ID NO: 256 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXISXXXXXLNPESKAIKNLLK

SEQ ID NO: 257 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXISXXXXXLNPESKAIKNLLK

SEQ ID NO: 258 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXISXXXXXLNPESKAIKNLLK

SEQ ID NO: 259 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXISXXXXXLNPESKAIKNLLK

SEQ ID NO: 260 - protein, 31 aa, Artificial Sequence
  Description of Artificial Sequence: Synthetic peptide
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISIXXXXKAIKNLLKAVSKE

SEQ ID NO: 261 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXISIXXXXKAIKNLLKAVSKE

SEQ ID NO: 262 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXISIXXXXKAIKNLLKAVSKE

SEQ ID NO: 263 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXISIXXXXKAIKNLLKAVSKE

SEQ ID NO: 264 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXISIXXXXKAIKNLLKAVSKE

SEQ ID NO: 265 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXISIXXXXKAIKNLLKAVSKE

SEQ ID NO: 266 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXISIXXXXKAIKNLLKAVSKE

SEQ ID NO: 267 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXISIXXXXKAIKNLLKAVSKE

SEQ ID NO: 268 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXISIXXXXKAIKNLLKAVSKE

SEQ ID NO: 269 - protein, 31 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCXSIXXXXKAIKNLLKAVSKE

SEQ ID NO: 270 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXXSIXXXXKAIKNLLKAVSKE

SEQ ID NO: 271 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXXSIXXXXKAIKNLLKAVSKE

SEQ ID NO: 272 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXXSIXXXXKAIKNLLKAVSKE

SEQ ID NO: 273 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXXSIXXXXKAIKNLLKAVSKE

SEQ ID NO: 274 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXXSIXXXXKAIKNLLKAVSKE

SEQ ID NO: 275 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXXSIXXXXKAIKNLLKAVSKE

SEQ ID NO: 276 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXXSIXXXXKAIKNLLKAVSKE

SEQ ID NO: 277 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXXSIXXXXKAIKNLLKAVSKE

SEQ ID NO: 278 - protein, 31 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCIXIXXXXKAIKNLLKAVSKE

SEQ ID NO: 279 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
XPLSRTVRXTXIXIXXXXKAIKNLLKAVSKE

SEQ ID NO: 280 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VXLSRTVRXTXIXIXXXXKAIKNLLKAVSKE

SEQ ID NO: 281 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPXSRTVRXTXIXIXXXXKAIKNLLKAVSKE

SEQ ID NO: 282 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLXRTVRXTXIXIXXXXKAIKNLLKAVSKE

SEQ ID NO: 283 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSXTVRXTXIXIXXXXKAIKNLLKAVSKE

SEQ ID NO: 284 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRXVRXTXIXIXXXXKAIKNLLKAVSKE

SEQ ID NO: 285 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTXRXTXIXIXXXXKAIKNLLKAVSKE

SEQ ID NO: 286 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVXXTXIXIXXXXKAIKNLLKAVSKE

SEQ ID NO: 287 - protein, 31 aa, Artificial Sequence
  Description of Artificial Sequence: Synthetic peptide
  MOD_RES (14)..(18): Any L- or D-natural or non-natural amino acid, and this range may  encompass 1 or 4 residues; see spe cification as filed for detailed  description of substitutions, R-groups and preferred embodi
  c-term may be amidated
VPLSRTVRCTCISXXXXXKAIKNLLKAVSKE

SEQ ID NO: 288 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPLSRTVRXTXISXXXXXKAIKNLLKAVSKE

SEQ ID NO: 289 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VXLSRTVRXTXISXXXXXKAIKNLLKAVSKE

SEQ ID NO: 290 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPXSRTVRXTXISXXXXXKAIKNLLKAVSKE

SEQ ID NO: 291 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPLXRTVRXTXISXXXXXKAIKNLLKAVSKE

SEQ ID NO: 292 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPLSXTVRXTXISXXXXXKAIKNLLKAVSKE

SEQ ID NO: 293 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPLSRXVRXTXISXXXXXKAIKNLLKAVSKE

SEQ ID NO: 294 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPLSRTXRXTXISXXXXXKAIKNLLKAVSKE

SEQ ID NO: 295 - protein, 31 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
VPLSRTVXXTXISXXXXXKAIKNLLKAVSKE

SEQ ID NO: 296 - protein, 34 aa, Artificial Sequence
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISNQXXXXLKAVSKEMSKRSP

SEQ ID NO: 297 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISNQXXXXLKAVSKEMSKRSP

SEQ ID NO: 298 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISNQXXXXLKAVSKEMSKRSP

SEQ ID NO: 299 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISNQXXXXLKAVSKEMSKRSP

SEQ ID NO: 300 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISNQXXXXLKAVSKEMSKRSP

SEQ ID NO: 301 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISNQXXXXLKAVSKEMSKRSP

SEQ ID NO: 302 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISNQXXXXLKAVSKEMSKRSP

SEQ ID NO: 303 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISNQXXXXLKAVSKEMSKRSP

SEQ ID NO: 304 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISNQXXXXLKAVSKEMSKRSP

SEQ ID NO: 305 - protein, 34 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCXSISNQXXXXLKAVSKEMSKRSP

SEQ ID NO: 306 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXXSISNQXXXXLKAVSKEMSKRSP

SEQ ID NO: 307 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXXSISNQXXXXLKAVSKEMSKRSP

SEQ ID NO: 308 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXXSISNQXXXXLKAVSKEMSKRSP

SEQ ID NO: 309 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXXSISNQXXXXLKAVSKEMSKRSP

SEQ ID NO: 310 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXXSISNQXXXXLKAVSKEMSKRSP

SEQ ID NO: 311 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXXSISNQXXXXLKAVSKEMSKRSP

SEQ ID NO: 312 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXXSISNQXXXXLKAVSKEMSKRSP

SEQ ID NO: 313 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXXSISNQXXXXLKAVSKEMSKRSP

SEQ ID NO: 314 - protein, 34 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCIXISNQXXXXLKAVSKEMSKRSP

SEQ ID NO: 315 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXIXISNQXXXXLKAVSKEMSKRSP

SEQ ID NO: 316 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXIXISNQXXXXLKAVSKEMSKRSP

SEQ ID NO: 317 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXIXISNQXXXXLKAVSKEMSKRSP

SEQ ID NO: 318 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXIXISNQXXXXLKAVSKEMSKRSP

SEQ ID NO: 319 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXIXISNQXXXXLKAVSKEMSKRSP

SEQ ID NO: 320 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXIXISNQXXXXLKAVSKEMSKRSP

SEQ ID NO: 321 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXIXISNQXXXXLKAVSKEMSKRSP

SEQ ID NO: 322 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXIXISNQXXXXLKAVSKEMSKRSP

SEQ ID NO: 323 - protein, 34 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISXSNQXXXXLKAVSKEMSKRSP

SEQ ID NO: 324 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISXSNQXXXXLKAVSKEMSKRSP

SEQ ID NO: 325 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISXSNQXXXXLKAVSKEMSKRSP

SEQ ID NO: 326 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISXSNQXXXXLKAVSKEMSKRSP

SEQ ID NO: 327 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISXSNQXXXXLKAVSKEMSKRSP

SEQ ID NO: 328 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISXSNQXXXXLKAVSKEMSKRSP

SEQ ID NO: 329 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISXSNQXXXXLKAVSKEMSKRSP

SEQ ID NO: 330 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISXSNQXXXXLKAVSKEMSKRSP

SEQ ID NO: 331 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISXSNQXXXXLKAVSKEMSKRSP

SEQ ID NO: 332 - protein, 34 aa, Artificial Sequence
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISXQXXXXLKAVSKEMSKRSP

SEQ ID NO: 333 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISXQXXXXLKAVSKEMSKRSP

SEQ ID NO: 334 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISXQXXXXLKAVSKEMSKRSP

SEQ ID NO: 335 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISXQXXXXLKAVSKEMSKRSP

SEQ ID NO: 336 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISXQXXXXLKAVSKEMSKRSP

SEQ ID NO: 337 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISXQXXXXLKAVSKEMSKRSP

SEQ ID NO: 338 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISXQXXXXLKAVSKEMSKRSP

SEQ ID NO: 339 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISXQXXXXLKAVSKEMSKRSP

SEQ ID NO: 340 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISXQXXXXLKAVSKEMSKRSP

SEQ ID NO: 341 - protein, 34 aa, Artificial Sequence
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISQXXXXXLKAVSKEMSKRSP

SEQ ID NO: 342 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISQXXXXXLKAVSKEMSKRSP

SEQ ID NO: 343 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISQXXXXXLKAVSKEMSKRSP

SEQ ID NO: 344 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISQXXXXXLKAVSKEMSKRSP

SEQ ID NO: 345 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISQXXXXXLKAVSKEMSKRSP

SEQ ID NO: 346 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISQXXXXXLKAVSKEMSKRSP

SEQ ID NO: 347 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISQXXXXXLKAVSKEMSKRSP

SEQ ID NO: 348 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISQXXXXXLKAVSKEMSKRSP

SEQ ID NO: 349 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISQXXXXXLKAVSKEMSKRSP

SEQ ID NO: 350 - protein, 34 aa, Artificial Sequence
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISNQXXXXLNPESKAIKNLLK

SEQ ID NO: 351 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISNQXXXXLNPESKAIKNLLK

SEQ ID NO: 352 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISNQXXXXLNPESKAIKNLLK

SEQ ID NO: 353 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISNQXXXXLNPESKAIKNLLK

SEQ ID NO: 354 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISNQXXXXLNPESKAIKNLLK

SEQ ID NO: 355 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISNQXXXXLNPESKAIKNLLK

SEQ ID NO: 356 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISNQXXXXLNPESKAIKNLLK

SEQ ID NO: 357 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISNQXXXXLNPESKAIKNLLK

SEQ ID NO: 358 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISNQXXXXLNPESKAIKNLLK

SEQ ID NO: 359 - protein, 34 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCXSISNQXXXXLNPESKAIKNLLK

SEQ ID NO: 360 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXXSISNQXXXXLNPESKAIKNLLK

SEQ ID NO: 361 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXXSISNQXXXXLNPESKAIKNLLK

SEQ ID NO: 362 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXXSISNQXXXXLNPESKAIKNLLK

SEQ ID NO: 363 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXXSISNQXXXXLNPESKAIKNLLK

SEQ ID NO: 364 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXXSISNQXXXXLNPESKAIKNLLK

SEQ ID NO: 365 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXXSISNQXXXXLNPESKAIKNLLK

SEQ ID NO: 366 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXXSISNQXXXXLNPESKAIKNLLK

SEQ ID NO: 367 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXXSISNQXXXXLNPESKAIKNLLK

SEQ ID NO: 368 - protein, 34 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCIXISNQXXXXLNPESKAIKNLLK

SEQ ID NO: 369 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXIXISNQXXXXLNPESKAIKNLLK

SEQ ID NO: 370 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXIXISNQXXXXLNPESKAIKNLLK

SEQ ID NO: 371 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXIXISNQXXXXLNPESKAIKNLLK

SEQ ID NO: 372 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXIXISNQXXXXLNPESKAIKNLLK

SEQ ID NO: 373 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXIXISNQXXXXLNPESKAIKNLLK

SEQ ID NO: 374 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXIXISNQXXXXLNPESKAIKNLLK

SEQ ID NO: 375 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXIXISNQXXXXLNPESKAIKNLLK

SEQ ID NO: 376 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXIXISNQXXXXLNPESKAIKNLLK

SEQ ID NO: 377 - protein, 34 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISXSNQXXXXLNPESKAIKNLLK

SEQ ID NO: 378 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISXSNQXXXXLNPESKAIKNLLK

SEQ ID NO: 379 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISXSNQXXXXLNPESKAIKNLLK

SEQ ID NO: 380 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISXSNQXXXXLNPESKAIKNLLK

SEQ ID NO: 381 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISXSNQXXXXLNPESKAIKNLLK

SEQ ID NO: 382 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISXSNQXXXXLNPESKAIKNLLK

SEQ ID NO: 383 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISXSNQXXXXLNPESKAIKNLLK

SEQ ID NO: 384 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISXSNQXXXXLNPESKAIKNLLK

SEQ ID NO: 385 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISXSNQXXXXLNPESKAIKNLLK

SEQ ID NO: 386 - protein, 34 aa, Artificial Sequence
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISXQXXXXLNPESKAIKNLLK

SEQ ID NO: 387 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISXQXXXXLNPESKAIKNLLK

SEQ ID NO: 388 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISXQXXXXLNPESKAIKNLLK

SEQ ID NO: 389 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISXQXXXXLNPESKAIKNLLK

SEQ ID NO: 390 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISXQXXXXLNPESKAIKNLLK

SEQ ID NO: 391 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISXQXXXXLNPESKAIKNLLK

SEQ ID NO: 392 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISXQXXXXLNPESKAIKNLLK

SEQ ID NO: 393 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISXQXXXXLNPESKAIKNLLK

SEQ ID NO: 394 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISXQXXXXLNPESKAIKNLLK

SEQ ID NO: 395 - protein, 34 aa, Artificial Sequence
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISQXXXXXLNPESKAIKNLLK

SEQ ID NO: 396 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISQXXXXXLNPESKAIKNLLK

SEQ ID NO: 397 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISQXXXXXLNPESKAIKNLLK

SEQ ID NO: 398 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISQXXXXXLNPESKAIKNLLK

SEQ ID NO: 399 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISQXXXXXLNPESKAIKNLLK

SEQ ID NO: 400 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISQXXXXXLNPESKAIKNLLK

SEQ ID NO: 401 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISQXXXXXLNPESKAIKNLLK

SEQ ID NO: 402 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISQXXXXXLNPESKAIKNLLK

SEQ ID NO: 403 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISQXXXXXLNPESKAIKNLLK

SEQ ID NO: 404 - protein, 34 aa, Artificial Sequence
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISNQXXXXKAIKNLLKAVSKE

SEQ ID NO: 405 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISNQXXXXKAIKNLLKAVSKE

SEQ ID NO: 406 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISNQXXXXKAIKNLLKAVSKE

SEQ ID NO: 407 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISNQXXXXKAIKNLLKAVSKE

SEQ ID NO: 408 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISNQXXXXKAIKNLLKAVSKE

SEQ ID NO: 409 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISNQXXXXKAIKNLLKAVSKE

SEQ ID NO: 410 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISNQXXXXKAIKNLLKAVSKE

SEQ ID NO: 411 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISNQXXXXKAIKNLLKAVSKE

SEQ ID NO: 412 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISNQXXXXKAIKNLLKAVSKE

SEQ ID NO: 413 - protein, 34 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCXSISNQXXXXKAIKNLLKAVSKE

SEQ ID NO: 414 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXXSISNQXXXXKAIKNLLKAVSKE

SEQ ID NO: 415 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXXSISNQXXXXKAIKNLLKAVSKE

SEQ ID NO: 416 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXXSISNQXXXXKAIKNLLKAVSKE

SEQ ID NO: 417 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXXSISNQXXXXKAIKNLLKAVSKE

SEQ ID NO: 418 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXXSISNQXXXXKAIKNLLKAVSKE

SEQ ID NO: 419 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXXSISNQXXXXKAIKNLLKAVSKE

SEQ ID NO: 420 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXXSISNQXXXXKAIKNLLKAVSKE

SEQ ID NO: 421 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXXSISNQXXXXKAIKNLLKAVSKE

SEQ ID NO: 422 - protein, 34 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCIXISNQXXXXKAIKNLLKAVSKE

SEQ ID NO: 423 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXIXISNQXXXXKAIKNLLKAVSKE

SEQ ID NO: 424 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXIXISNQXXXXKAIKNLLKAVSKE

SEQ ID NO: 425 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXIXISNQXXXXKAIKNLLKAVSKE

SEQ ID NO: 426 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXIXISNQXXXXKAIKNLLKAVSKE

SEQ ID NO: 427 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXIXISNQXXXXKAIKNLLKAVSKE

SEQ ID NO: 428 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXIXISNQXXXXKAIKNLLKAVSKE

SEQ ID NO: 429 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXIXISNQXXXXKAIKNLLKAVSKE

SEQ ID NO: 430 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXIXISNQXXXXKAIKNLLKAVSKE

SEQ ID NO: 431 - protein, 34 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISXSNQXXXXKAIKNLLKAVSKE

SEQ ID NO: 432 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISXSNQXXXXKAIKNLLKAVSKE

SEQ ID NO: 433 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISXSNQXXXXKAIKNLLKAVSKE

SEQ ID NO: 434 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISXSNQXXXXKAIKNLLKAVSKE

SEQ ID NO: 435 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISXSNQXXXXKAIKNLLKAVSKE

SEQ ID NO: 436 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISXSNQXXXXKAIKNLLKAVSKE

SEQ ID NO: 437 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISXSNQXXXXKAIKNLLKAVSKE

SEQ ID NO: 438 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISXSNQXXXXKAIKNLLKAVSKE

SEQ ID NO: 439 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISXSNQXXXXKAIKNLLKAVSKE

SEQ ID NO: 440 - protein, 34 aa, Artificial Sequence
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISXQXXXXKAIKNLLKAVSKE

SEQ ID NO: 441 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISXQXXXXKAIKNLLKAVSKE

SEQ ID NO: 442 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISXQXXXXKAIKNLLKAVSKE

SEQ ID NO: 443 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISXQXXXXKAIKNLLKAVSKE

SEQ ID NO: 444 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISXQXXXXKAIKNLLKAVSKE

SEQ ID NO: 445 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISXQXXXXKAIKNLLKAVSKE

SEQ ID NO: 446 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISXQXXXXKAIKNLLKAVSKE

SEQ ID NO: 447 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISXQXXXXKAIKNLLKAVSKE

SEQ ID NO: 448 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISXQXXXXKAIKNLLKAVSKE

SEQ ID NO: 449 - protein, 34 aa, Artificial Sequence
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVRCTCISISQXXXXXKAIKNLLKAVSKE

SEQ ID NO: 450 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XPLSRTVRXTXISISQXXXXXKAIKNLLKAVSKE

SEQ ID NO: 451 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VXLSRTVRXTXISISQXXXXXKAIKNLLKAVSKE

SEQ ID NO: 452 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPXSRTVRXTXISISQXXXXXKAIKNLLKAVSKE

SEQ ID NO: 453 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLXRTVRXTXISISQXXXXXKAIKNLLKAVSKE

SEQ ID NO: 454 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSXTVRXTXISISQXXXXXKAIKNLLKAVSKE

SEQ ID NO: 455 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRXVRXTXISISQXXXXXKAIKNLLKAVSKE

SEQ ID NO: 456 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTXRXTXISISQXXXXXKAIKNLLKAVSKE

SEQ ID NO: 457 - protein, 34 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
VPLSRTVXXTXISISQXXXXXKAIKNLLKAVSKE

SEQ ID NO: 458 - protein, 31 aa, Artificial Sequence; identical to SEQ ID NO: 188
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 459 - protein, 31 aa, Artificial Sequence; identical to SEQ ID NO: 189
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 460 - protein, 31 aa, Artificial Sequence; identical to SEQ ID NO: 190
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 461 - protein, 31 aa, Artificial Sequence; identical to SEQ ID NO: 191
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 462 - protein, 31 aa, Artificial Sequence; identical to SEQ ID NO: 192
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 463 - protein, 31 aa, Artificial Sequence; identical to SEQ ID NO: 193
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 464 - protein, 31 aa, Artificial Sequence; identical to SEQ ID NO: 194
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 465 - protein, 31 aa, Artificial Sequence; identical to SEQ ID NO: 195
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 466 - protein, 31 aa, Artificial Sequence; identical to SEQ ID NO: 196
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 467 - protein, 31 aa, Artificial Sequence; identical to SEQ ID NO: 197
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 468 - protein, 31 aa, Artificial Sequence; identical to SEQ ID NO: 198
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 469 - protein, 31 aa, Artificial Sequence; identical to SEQ ID NO: 199
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 470 - protein, 31 aa, Artificial Sequence; identical to SEQ ID NO: 200
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 471 - protein, 31 aa, Artificial Sequence; identical to SEQ ID NO: 201
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 472 - protein, 31 aa, Artificial Sequence; identical to SEQ ID NO: 202
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 473 - protein, 31 aa, Artificial Sequence; identical to SEQ ID NO: 203
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 474 - protein, 31 aa, Artificial Sequence; identical to SEQ ID NO: 204
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 475 - protein, 31 aa, Artificial Sequence; identical to SEQ ID NO: 205
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 476 - protein, 31 aa, Artificial Sequence; identical to SEQ ID NO: 206
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 477 - protein, 31 aa, Artificial Sequence; identical to SEQ ID NO: 207
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 478 - protein, 31 aa, Artificial Sequence; identical to SEQ ID NO: 208
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 479 - protein, 31 aa, Artificial Sequence; identical to SEQ ID NO: 209
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 480 - protein, 31 aa, Artificial Sequence; identical to SEQ ID NO: 210
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 481 - protein, 31 aa, Artificial Sequence; identical to SEQ ID NO: 211
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 482 - protein, 31 aa, Artificial Sequence; identical to SEQ ID NO: 212
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 483 - protein, 31 aa, Artificial Sequence; identical to SEQ ID NO: 213
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 484 - protein, 31 aa, Artificial Sequence; identical to SEQ ID NO: 214
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 485 - protein, 31 aa, Artificial Sequence; identical to SEQ ID NO: 215
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 486 - protein, 31 aa, Artificial Sequence; identical to SEQ ID NO: 216
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 487 - protein, 31 aa, Artificial Sequence; identical to SEQ ID NO: 217
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 488 - protein, 31 aa, Artificial Sequence; identical to SEQ ID NO: 218
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 489 - protein, 31 aa, Artificial Sequence; identical to SEQ ID NO: 219
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 490 - protein, 31 aa, Artificial Sequence; identical to SEQ ID NO: 220
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 491 - protein, 31 aa, Artificial Sequence; identical to SEQ ID NO: 221
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 492 - protein, 31 aa, Artificial Sequence; identical to SEQ ID NO: 222
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 493 - protein, 31 aa, Artificial Sequence; identical to SEQ ID NO: 223
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 494 - protein, 34 aa, Artificial Sequence; identical to SEQ ID NO: 296
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 495 - protein, 34 aa, Artificial Sequence; identical to SEQ ID NO: 297
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 496 - protein, 34 aa, Artificial Sequence; identical to SEQ ID NO: 298
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 497 - protein, 34 aa, Artificial Sequence; identical to SEQ ID NO: 299
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 498 - protein, 34 aa, Artificial Sequence; identical to SEQ ID NO: 300
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 499 - protein, 34 aa, Artificial Sequence; identical to SEQ ID NO: 301
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 500 - protein, 34 aa, Artificial Sequence; identical to SEQ ID NO: 302
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 501 - protein, 34 aa, Artificial Sequence; identical to SEQ ID NO: 303
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 502 - protein, 34 aa, Artificial Sequence; identical to SEQ ID NO: 304
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 503 - protein, 34 aa, Artificial Sequence; identical to SEQ ID NO: 305
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 504 - protein, 34 aa, Artificial Sequence; identical to SEQ ID NO: 306
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 505 - protein, 34 aa, Artificial Sequence; identical to SEQ ID NO: 307
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 506 - protein, 34 aa, Artificial Sequence; identical to SEQ ID NO: 308
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 507 - protein, 34 aa, Artificial Sequence; identical to SEQ ID NO: 309
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 508 - protein, 34 aa, Artificial Sequence; identical to SEQ ID NO: 310
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 509 - protein, 34 aa, Artificial Sequence; identical to SEQ ID NO: 311
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 510 - protein, 34 aa, Artificial Sequence; identical to SEQ ID NO: 312
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 511 - protein, 34 aa, Artificial Sequence; identical to SEQ ID NO: 313
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 512 - protein, 34 aa, Artificial Sequence; identical to SEQ ID NO: 314
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 513 - protein, 34 aa, Artificial Sequence; identical to SEQ ID NO: 315
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 514 - protein, 34 aa, Artificial Sequence; identical to SEQ ID NO: 316
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 515 - protein, 34 aa, Artificial Sequence; identical to SEQ ID NO: 317
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 516 - protein, 34 aa, Artificial Sequence; identical to SEQ ID NO: 318
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 517 - protein, 34 aa, Artificial Sequence; identical to SEQ ID NO: 319
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 518 - protein, 34 aa, Artificial Sequence; identical to SEQ ID NO: 320
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 519 - protein, 34 aa, Artificial Sequence; identical to SEQ ID NO: 321
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 520 - protein, 34 aa, Artificial Sequence; identical to SEQ ID NO: 322
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 521 - protein, 34 aa, Artificial Sequence; identical to SEQ ID NO: 323
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 522 - protein, 34 aa, Artificial Sequence; identical to SEQ ID NO: 324
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 523 - protein, 34 aa, Artificial Sequence; identical to SEQ ID NO: 325
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 524 - protein, 34 aa, Artificial Sequence; identical to SEQ ID NO: 326
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 525 - protein, 34 aa, Artificial Sequence; identical to SEQ ID NO: 327
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 526 - protein, 34 aa, Artificial Sequence; identical to SEQ ID NO: 328
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 527 - protein, 34 aa, Artificial Sequence; identical to SEQ ID NO: 329
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 528 - protein, 34 aa, Artificial Sequence; identical to SEQ ID NO: 330
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 529 - protein, 34 aa, Artificial Sequence; identical to SEQ ID NO: 331
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 530 - protein, 34 aa, Artificial Sequence; identical to SEQ ID NO: 332
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 531 - protein, 34 aa, Artificial Sequence; identical to SEQ ID NO: 333
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 532 - protein, 34 aa, Artificial Sequence; identical to SEQ ID NO: 334
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 533 - protein, 34 aa, Artificial Sequence; identical to SEQ ID NO: 335
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 534 - protein, 34 aa, Artificial Sequence; identical to SEQ ID NO: 336
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 535 - protein, 34 aa, Artificial Sequence; identical to SEQ ID NO: 337
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 536 - protein, 34 aa, Artificial Sequence; identical to SEQ ID NO: 338
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 537 - protein, 34 aa, Artificial Sequence; identical to SEQ ID NO: 339
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 538 - protein, 34 aa, Artificial Sequence; identical to SEQ ID NO: 340
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 539 - protein, 34 aa, Artificial Sequence; identical to SEQ ID NO: 341
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 540 - protein, 34 aa, Artificial Sequence; identical to SEQ ID NO: 342
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 541 - protein, 34 aa, Artificial Sequence; identical to SEQ ID NO: 343
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 542 - protein, 34 aa, Artificial Sequence; identical to SEQ ID NO: 344
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 543 - protein, 34 aa, Artificial Sequence; identical to SEQ ID NO: 345
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 544 - protein, 34 aa, Artificial Sequence; identical to SEQ ID NO: 346
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 545 - protein, 34 aa, Artificial Sequence; identical to SEQ ID NO: 347
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 546 - protein, 34 aa, Artificial Sequence; identical to SEQ ID NO: 348
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 547 - skipped

SEQ ID NO: 548 - protein, 34 aa, Artificial Sequence; identical to SEQ ID NO: 349
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 549 - protein, 31 aa, Artificial Sequence; identical to SEQ ID NO: 224
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 550 - protein, 31 aa, Artificial Sequence; identical to SEQ ID NO: 225
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 551 - protein, 31 aa, Artificial Sequence; identical to SEQ ID NO: 226
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 552 - protein, 31 aa, Artificial Sequence; identical to SEQ ID NO: 227
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 553 - protein, 31 aa, Artificial Sequence; identical to SEQ ID NO: 228
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 554 - protein, 31 aa, Artificial Sequence; identical to SEQ ID NO: 229
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 555 - protein, 31 aa, Artificial Sequence; identical to SEQ ID NO: 230
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 556 - protein, 31 aa, Artificial Sequence; identical to SEQ ID NO: 231
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 557 - protein, 31 aa, Artificial Sequence; identical to SEQ ID NO: 232
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 558 - protein, 31 aa, Artificial Sequence; identical to SEQ ID NO: 233
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 559 - protein, 31 aa, Artificial Sequence; identical to SEQ ID NO: 234
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 560 - protein, 31 aa, Artificial Sequence; identical to SEQ ID NO: 235
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 561 - protein, 31 aa, Artificial Sequence; identical to SEQ ID NO: 236
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 562 - protein, 31 aa, Artificial Sequence; identical to SEQ ID NO: 237
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 563 - protein, 31 aa, Artificial Sequence; identical to SEQ ID NO: 238
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 564 - protein, 31 aa, Artificial Sequence; identical to SEQ ID NO: 239
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 565 - protein, 31 aa, Artificial Sequence; identical to SEQ ID NO: 240
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 566 - protein, 31 aa, Artificial Sequence; identical to SEQ ID NO: 241
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 567 - protein, 31 aa, Artificial Sequence; identical to SEQ ID NO: 242
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 568 - protein, 31 aa, Artificial Sequence; identical to SEQ ID NO: 243
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 569 - protein, 31 aa, Artificial Sequence; identical to SEQ ID NO: 244
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 570 - protein, 31 aa, Artificial Sequence; identical to SEQ ID NO: 245
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 571 - protein, 31 aa, Artificial Sequence; identical to SEQ ID NO: 246
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 572 - protein, 31 aa, Artificial Sequence; identical to SEQ ID NO: 247
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 573 - protein, 31 aa, Artificial Sequence; identical to SEQ ID NO: 248
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 574 - protein, 31 aa, Artificial Sequence; identical to SEQ ID NO: 249
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 575 - protein, 31 aa, Artificial Sequence; identical to SEQ ID NO: 250
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 576 - protein, 31 aa, Artificial Sequence; identical to SEQ ID NO: 251
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 577 - protein, 31 aa, Artificial Sequence; identical to SEQ ID NO: 252
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 578 - protein, 31 aa, Artificial Sequence; identical to SEQ ID NO: 253
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 579 - protein, 31 aa, Artificial Sequence; identical to SEQ ID NO: 254
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 580 - protein, 31 aa, Artificial Sequence; identical to SEQ ID NO: 255
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 581 - protein, 31 aa, Artificial Sequence; identical to SEQ ID NO: 256
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 582 - protein, 31 aa, Artificial Sequence; identical to SEQ ID NO: 257
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 583 - protein, 31 aa, Artificial Sequence; identical to SEQ ID NO: 258
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 584 - protein, 31 aa, Artificial Sequence; identical to SEQ ID NO: 259
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 585 - protein, 34 aa, Artificial Sequence; identical to SEQ ID NO: 350
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 586 - protein, 34 aa, Artificial Sequence; identical to SEQ ID NO: 351
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 587 - protein, 34 aa, Artificial Sequence; identical to SEQ ID NO: 352
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 588 - protein, 34 aa, Artificial Sequence; identical to SEQ ID NO: 353
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 589 - protein, 34 aa, Artificial Sequence; identical to SEQ ID NO: 354
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 590 - protein, 34 aa, Artificial Sequence; identical to SEQ ID NO: 355
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 591 - protein, 34 aa, Artificial Sequence; identical to SEQ ID NO: 356
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 592 - protein, 34 aa, Artificial Sequence; identical to SEQ ID NO: 357
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 593 - protein, 34 aa, Artificial Sequence; identical to SEQ ID NO: 358
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 594 - protein, 34 aa, Artificial Sequence; identical to SEQ ID NO: 359
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 595 - protein, 34 aa, Artificial Sequence; identical to SEQ ID NO: 360
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 596 - protein, 34 aa, Artificial Sequence; identical to SEQ ID NO: 361
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 597 - protein, 34 aa, Artificial Sequence; identical to SEQ ID NO: 362
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 598 - protein, 34 aa, Artificial Sequence; identical to SEQ ID NO: 363
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 599 - protein, 34 aa, Artificial Sequence; identical to SEQ ID NO: 364
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 600 - protein, 34 aa, Artificial Sequence; identical to SEQ ID NO: 365
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 601 - protein, 34 aa, Artificial Sequence; identical to SEQ ID NO: 366
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 602 - protein, 34 aa, Artificial Sequence; identical to SEQ ID NO: 367
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 603 - protein, 34 aa, Artificial Sequence; identical to SEQ ID NO: 368
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 604 - protein, 34 aa, Artificial Sequence; identical to SEQ ID NO: 369
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 605 - protein, 34 aa, Artificial Sequence; identical to SEQ ID NO: 370
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 606 - protein, 34 aa, Artificial Sequence; identical to SEQ ID NO: 371
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 607 - protein, 34 aa, Artificial Sequence; identical to SEQ ID NO: 372
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 608 - protein, 34 aa, Artificial Sequence; identical to SEQ ID NO: 373
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 609 - protein, 34 aa, Artificial Sequence; identical to SEQ ID NO: 374
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 610 - protein, 34 aa, Artificial Sequence; identical to SEQ ID NO: 375
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 611 - protein, 34 aa, Artificial Sequence; identical to SEQ ID NO: 376
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 612 - protein, 34 aa, Artificial Sequence; identical to SEQ ID NO: 377
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 613 - protein, 34 aa, Artificial Sequence; identical to SEQ ID NO: 378
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 614 - protein, 34 aa, Artificial Sequence; identical to SEQ ID NO: 379
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 615 - protein, 34 aa, Artificial Sequence; identical to SEQ ID NO: 380
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 616 - protein, 34 aa, Artificial Sequence; identical to SEQ ID NO: 381
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 617 - protein, 34 aa, Artificial Sequence; identical to SEQ ID NO: 382
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 618 - protein, 34 aa, Artificial Sequence; identical to SEQ ID NO: 383
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 619 - protein, 34 aa, Artificial Sequence; identical to SEQ ID NO: 384
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 620 - protein, 34 aa, Artificial Sequence; identical to SEQ ID NO: 385
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 621 - protein, 34 aa, Artificial Sequence; identical to SEQ ID NO: 386
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 622 - protein, 34 aa, Artificial Sequence; identical to SEQ ID NO: 387
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 623 - protein, 34 aa, Artificial Sequence; identical to SEQ ID NO: 388
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 624 - protein, 34 aa, Artificial Sequence; identical to SEQ ID NO: 389
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 625 - protein, 34 aa, Artificial Sequence; identical to SEQ ID NO: 390
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 626 - protein, 34 aa, Artificial Sequence; identical to SEQ ID NO: 391
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 627 - protein, 34 aa, Artificial Sequence; identical to SEQ ID NO: 392
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 628 - protein, 34 aa, Artificial Sequence; identical to SEQ ID NO: 393
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 629 - protein, 34 aa, Artificial Sequence; identical to SEQ ID NO: 394
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 630 - protein, 34 aa, Artificial Sequence; identical to SEQ ID NO: 395
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 631 - protein, 34 aa, Artificial Sequence; identical to SEQ ID NO: 396
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 632 - protein, 34 aa, Artificial Sequence; identical to SEQ ID NO: 397
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 633 - protein, 34 aa, Artificial Sequence; identical to SEQ ID NO: 398
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 634 - protein, 34 aa, Artificial Sequence; identical to SEQ ID NO: 399
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 635 - protein, 34 aa, Artificial Sequence; identical to SEQ ID NO: 400
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 636 - protein, 34 aa, Artificial Sequence; identical to SEQ ID NO: 401
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 637 - protein, 34 aa, Artificial Sequence; identical to SEQ ID NO: 402
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 638 - protein, 34 aa, Artificial Sequence; identical to SEQ ID NO: 403
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 639 - protein, 31 aa, Artificial Sequence; identical to SEQ ID NO: 260
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 640 - protein, 31 aa, Artificial Sequence; identical to SEQ ID NO: 261
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 641 - protein, 31 aa, Artificial Sequence; identical to SEQ ID NO: 262
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 642 - protein, 31 aa, Artificial Sequence; identical to SEQ ID NO: 263
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 643 - protein, 31 aa, Artificial Sequence; identical to SEQ ID NO: 264
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 644 - protein, 31 aa, Artificial Sequence; identical to SEQ ID NO: 265
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 645 - protein, 31 aa, Artificial Sequence; identical to SEQ ID NO: 266
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 646 - protein, 31 aa, Artificial Sequence; identical to SEQ ID NO: 267
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 647 - protein, 31 aa, Artificial Sequence; identical to SEQ ID NO: 268
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 648 - protein, 31 aa, Artificial Sequence; identical to SEQ ID NO: 269
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 649 - protein, 31 aa, Artificial Sequence; identical to SEQ ID NO: 270
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 650 - protein, 31 aa, Artificial Sequence; identical to SEQ ID NO: 271
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 651 - protein, 31 aa, Artificial Sequence; identical to SEQ ID NO: 272
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 652 - protein, 31 aa, Artificial Sequence; identical to SEQ ID NO: 273
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 653 - protein, 31 aa, Artificial Sequence; identical to SEQ ID NO: 274
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 654 - protein, 31 aa, Artificial Sequence; identical to SEQ ID NO: 275
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 655 - protein, 31 aa, Artificial Sequence; identical to SEQ ID NO: 276
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 656 - protein, 31 aa, Artificial Sequence; identical to SEQ ID NO: 277
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 657 - protein, 31 aa, Artificial Sequence; identical to SEQ ID NO: 278
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 658 - protein, 31 aa, Artificial Sequence; identical to SEQ ID NO: 279
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 659 - protein, 31 aa, Artificial Sequence; identical to SEQ ID NO: 280
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 660 - protein, 31 aa, Artificial Sequence; identical to SEQ ID NO: 281
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 661 - protein, 31 aa, Artificial Sequence; identical to SEQ ID NO: 282
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 662 - protein, 31 aa, Artificial Sequence; identical to SEQ ID NO: 283
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 663 - protein, 31 aa, Artificial Sequence; identical to SEQ ID NO: 284
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 664 - protein, 31 aa, Artificial Sequence; identical to SEQ ID NO: 285
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 665 - protein, 31 aa, Artificial Sequence; identical to SEQ ID NO: 286
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 666 - protein, 31 aa, Artificial Sequence; identical to SEQ ID NO: 287
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 667 - protein, 31 aa, Artificial Sequence; identical to SEQ ID NO: 288
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 668 - protein, 31 aa, Artificial Sequence; identical to SEQ ID NO: 289
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 669 - protein, 31 aa, Artificial Sequence; identical to SEQ ID NO: 290
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 670 - protein, 31 aa, Artificial Sequence; identical to SEQ ID NO: 291
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 671 - protein, 31 aa, Artificial Sequence; identical to SEQ ID NO: 292
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 672 - protein, 31 aa, Artificial Sequence; identical to SEQ ID NO: 293
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 673 - protein, 31 aa, Artificial Sequence; identical to SEQ ID NO: 294
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 674 - protein, 31 aa, Artificial Sequence; identical to SEQ ID NO: 295
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 675 - protein, 34 aa, Artificial Sequence; identical to SEQ ID NO: 404
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 676 - protein, 34 aa, Artificial Sequence; identical to SEQ ID NO: 405
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 677 - protein, 34 aa, Artificial Sequence; identical to SEQ ID NO: 406
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 678 - protein, 34 aa, Artificial Sequence; identical to SEQ ID NO: 407
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 679 - protein, 34 aa, Artificial Sequence; identical to SEQ ID NO: 408
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 680 - protein, 34 aa, Artificial Sequence; identical to SEQ ID NO: 409
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 681 - protein, 34 aa, Artificial Sequence; identical to SEQ ID NO: 410
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 682 - protein, 34 aa, Artificial Sequence; identical to SEQ ID NO: 411
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 683 - protein, 34 aa, Artificial Sequence; identical to SEQ ID NO: 412
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 684 - protein, 34 aa, Artificial Sequence; identical to SEQ ID NO: 413
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 685 - protein, 34 aa, Artificial Sequence; identical to SEQ ID NO: 414
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 686 - protein, 34 aa, Artificial Sequence; identical to SEQ ID NO: 415
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 687 - protein, 34 aa, Artificial Sequence; identical to SEQ ID NO: 416
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 688 - protein, 34 aa, Artificial Sequence; identical to SEQ ID NO: 417
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 689 - protein, 34 aa, Artificial Sequence; identical to SEQ ID NO: 418
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 690 - protein, 34 aa, Artificial Sequence; identical to SEQ ID NO: 419
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 691 - protein, 34 aa, Artificial Sequence; identical to SEQ ID NO: 420
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 692 - protein, 34 aa, Artificial Sequence; identical to SEQ ID NO: 421
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 693 - protein, 34 aa, Artificial Sequence; identical to SEQ ID NO: 422
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 694 - protein, 34 aa, Artificial Sequence; identical to SEQ ID NO: 423
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 695 - protein, 34 aa, Artificial Sequence; identical to SEQ ID NO: 424
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 696 - protein, 34 aa, Artificial Sequence; identical to SEQ ID NO: 425
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 697 - protein, 34 aa, Artificial Sequence; identical to SEQ ID NO: 426
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 698 - protein, 34 aa, Artificial Sequence; identical to SEQ ID NO: 427
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 699 - protein, 34 aa, Artificial Sequence; identical to SEQ ID NO: 428
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 700 - protein, 34 aa, Artificial Sequence; identical to SEQ ID NO: 429
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 701 - protein, 34 aa, Artificial Sequence; identical to SEQ ID NO: 430
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 702 - protein, 34 aa, Artificial Sequence; identical to SEQ ID NO: 431
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 703 - protein, 34 aa, Artificial Sequence; identical to SEQ ID NO: 432
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 704 - protein, 34 aa, Artificial Sequence; identical to SEQ ID NO: 433
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 705 - protein, 34 aa, Artificial Sequence; identical to SEQ ID NO: 434
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 706 - protein, 34 aa, Artificial Sequence; identical to SEQ ID NO: 435
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 707 - protein, 34 aa, Artificial Sequence; identical to SEQ ID NO: 436
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 708 - protein, 34 aa, Artificial Sequence; identical to SEQ ID NO: 437
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 709 - protein, 34 aa, Artificial Sequence; identical to SEQ ID NO: 438
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 710 - protein, 34 aa, Artificial Sequence; identical to SEQ ID NO: 439
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 711 - protein, 34 aa, Artificial Sequence; identical to SEQ ID NO: 440
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 712 - protein, 34 aa, Artificial Sequence; identical to SEQ ID NO: 441
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 713 - protein, 34 aa, Artificial Sequence; identical to SEQ ID NO: 442
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 714 - protein, 34 aa, Artificial Sequence; identical to SEQ ID NO: 443
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 715 - protein, 34 aa, Artificial Sequence; identical to SEQ ID NO: 444
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 716 - protein, 34 aa, Artificial Sequence; identical to SEQ ID NO: 445
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 717 - protein, 34 aa, Artificial Sequence; identical to SEQ ID NO: 446
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 718 - protein, 34 aa, Artificial Sequence; identical to SEQ ID NO: 447
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 719 - protein, 34 aa, Artificial Sequence; identical to SEQ ID NO: 448
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 720 - protein, 34 aa, Artificial Sequence; identical to SEQ ID NO: 449
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 721 - protein, 34 aa, Artificial Sequence; identical to SEQ ID NO: 450
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 722 - protein, 34 aa, Artificial Sequence; identical to SEQ ID NO: 451
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 723 - protein, 34 aa, Artificial Sequence; identical to SEQ ID NO: 452
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 724 - protein, 34 aa, Artificial Sequence; identical to SEQ ID NO: 453
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 725 - protein, 34 aa, Artificial Sequence; identical to SEQ ID NO: 454
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 726 - protein, 34 aa, Artificial Sequence; identical to SEQ ID NO: 455
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 727 - protein, 34 aa, Artificial Sequence; identical to SEQ ID NO: 456
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 728 - protein, 34 aa, Artificial Sequence; identical to SEQ ID NO: 457
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 729 - protein, 9 aa, Artificial Sequence
  Description of Artificial Sequence: Synthetic peptide
  c-term may be amidated
SLAADTPTA

SEQ ID NO: 730 - protein, 21 aa, Artificial Sequence
  Description of Artificial Sequence: Synthetic peptide
  c-term may be amidated
AFSYTSRQIPQNADYFETSSQ

SEQ ID NO: 731 - protein, 15 aa, Artificial Sequence [sequence omitted]

SEQ ID NO: 732 - protein, 30 aa, Artificial Sequence
  Description of Artificial Sequence: Synthetic peptide
  c-term may be amidated
SLAADTPTCCFSYTSRQIPQNADYFETSSQ

SEQ ID NO: 733 - protein, 30 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
XLAADTPTXXFSYTSRQIPQNADYFETSSQ

SEQ ID NO: 734 - protein, 30 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SXAADTPTXXFSYTSRQIPQNADYFETSSQ

SEQ ID NO: 735 - protein, 30 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SLXADTPTXXFSYTSRQIPQNADYFETSSQ

SEQ ID NO: 736 - protein, 30 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SLAXDTPTXXFSYTSRQIPQNADYFETSSQ

SEQ ID NO: 737 - protein, 30 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SLAAXTPTXXFSYTSRQIPQNADYFETSSQ

SEQ ID NO: 738 - protein, 30 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SLAADXPTXXFSYTSRQIPQNADYFETSSQ

SEQ ID NO: 739 - protein, 30 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  c-term may be amidated
SLAADTXTXXFSYTSRQIPQNADYFETSSQ

SEQ ID NO: 740 - protein, 30 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  c-term may be amidated
SLAADTPXXXFSYTSRQIPQNADYFETSSQ

SEQ ID NO: 741 - protein, 18 aa, Artificial Sequence
  Description of Artificial Sequence: Synthetic peptide
  c-term may be amidated
ADPSEEWVQYVDDLELSA

SEQ ID NO: 742 - protein, 32 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTCCFSYTXXXXEEWVQYVDDLELSA

SEQ ID NO: 743 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSYTXXXXEEWVQYVDDLELSA

SEQ ID NO: 744 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSYTXXXXEEWVQYVDDLELSA

SEQ ID NO: 745 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSYTXXXXEEWVQYVDDLELSA

SEQ ID NO: 746 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSYTXXXXEEWVQYVDDLELSA

SEQ ID NO: 747 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSYTXXXXEEWVQYVDDLELSA

SEQ ID NO: 748 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSYTXXXXEEWVQYVDDLELSA

SEQ ID NO: 749 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSYTXXXXEEWVQYVDDLELSA

SEQ ID NO: 750 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSYTXXXXEEWVQYVDDLELSA

SEQ ID NO: 751 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSYTXXXXEEWVQYVDDLELSA

SEQ ID NO: 752 - protein, 32 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXXSYTXXXXEEWVQYVDDLELSA

SEQ ID NO: 753 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXXSYTXXXXEEWVQYVDDLELSA

SEQ ID NO: 754 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXXSYTXXXXEEWVQYVDDLELSA

SEQ ID NO: 755 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXXSYTXXXXEEWVQYVDDLELSA

SEQ ID NO: 756 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXXSYTXXXXEEWVQYVDDLELSA

SEQ ID NO: 757 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXXSYTXXXXEEWVQYVDDLELSA

SEQ ID NO: 758 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXXSYTXXXXEEWVQYVDDLELSA

SEQ ID NO: 759 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXXSYTXXXXEEWVQYVDDLELSA

SEQ ID NO: 760 - protein, 32 aa, Artificial Sequence
  Description of Artificial Sequence: Synthetic peptide
  MOD_RES (8)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXXSYTXXXXEEWVQYVDDLELSA

SEQ ID NO: 761 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFXYTXXXXEEWVQYVDDLELSA

SEQ ID NO: 762 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFXYTXXXXEEWVQYVDDLELSA

SEQ ID NO: 763 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFXYTXXXXEEWVQYVDDLELSA

SEQ ID NO: 764 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFXYTXXXXEEWVQYVDDLELSA

SEQ ID NO: 765 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFXYTXXXXEEWVQYVDDLELSA

SEQ ID NO: 766 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFXYTXXXXEEWVQYVDDLELSA

SEQ ID NO: 767 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFXYTXXXXEEWVQYVDDLELSA

SEQ ID NO: 768 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFXYTXXXXEEWVQYVDDLELSA

SEQ ID NO: 769 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFXYTXXXXEEWVQYVDDLELSA

SEQ ID NO: 770 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSXTXXXXEEWVQYVDDLELSA

SEQ ID NO: 771 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSXTXXXXEEWVQYVDDLELSA

SEQ ID NO: 772 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSXTXXXXEEWVQYVDDLELSA

SEQ ID NO: 773 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSXTXXXXEEWVQYVDDLELSA

SEQ ID NO: 774 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSXTXXXXEEWVQYVDDLELSA

SEQ ID NO: 775 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSXTXXXXEEWVQYVDDLELSA

SEQ ID NO: 776 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSXTXXXXEEWVQYVDDLELSA

SEQ ID NO: 777 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSXTXXXXEEWVQYVDDLELSA

SEQ ID NO: 778 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSXTXXXXEEWVQYVDDLELSA

SEQ ID NO: 779 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSYXXXXXEEWVQYVDDLELSA

SEQ ID NO: 780 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSYXXXXXEEWVQYVDDLELSA

SEQ ID NO: 781 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSYXXXXXEEWVQYVDDLELSA

SEQ ID NO: 782 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSYXXXXXEEWVQYVDDLELSA

SEQ ID NO: 783 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSYXXXXXEEWVQYVDDLELSA

SEQ ID NO: 784 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSYXXXXXEEWVQYVDDLELSA

SEQ ID NO: 785 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSYXXXXXEEWVQYVDDLELSA

SEQ ID NO: 786 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSYXXXXXEEWVQYVDDLELSA

SEQ ID NO: 787 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSYXXXXXEEWVQYVDDLELSA

SEQ ID NO: 788 - protein, 32 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTCCFSYTXXXXEEWVKYVDDLELSA

SEQ ID NO: 789 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSYTXXXXEEWVKYVDDLELSA

SEQ ID NO: 790 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSYTXXXXEEWVKYVDDLELSA

SEQ ID NO: 791 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSYTXXXXEEWVKYVDDLELSA

SEQ ID NO: 792 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSYTXXXXEEWVKYVDDLELSA

SEQ ID NO: 793 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSYTXXXXEEWVKYVDDLELSA

SEQ ID NO: 794 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSYTXXXXEEWVKYVDDLELSA

SEQ ID NO: 795 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSYTXXXXEEWVKYVDDLELSA

SEQ ID NO: 796 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSYTXXXXEEWVKYVDDLELSA

SEQ ID NO: 797 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSYTXXXXEEWVKYVDDLELSA

SEQ ID NO: 798 - protein, 32 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXXSYTXXXXEEWVKYVDDLELSA

SEQ ID NO: 799 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXXSYTXXXXEEWVKYVDDLELSA

SEQ ID NO: 800 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXXSYTXXXXEEWVKYVDDLELSA

SEQ ID NO: 801 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXXSYTXXXXEEWVKYVDDLELSA

SEQ ID NO: 802 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXXSYTXXXXEEWVKYVDDLELSA

SEQ ID NO: 803 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXXSYTXXXXEEWVKYVDDLELSA

SEQ ID NO: 804 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXXSYTXXXXEEWVKYVDDLELSA

SEQ ID NO: 805 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXXSYTXXXXEEWVKYVDDLELSA

SEQ ID NO: 806 - protein, 32 aa, Artificial Sequence
  Description of Artificial Sequence: Synthetic peptide
  MOD_RES (8)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXXSYTXXXXEEWVKYVDDLELSA

SEQ ID NO: 807 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFXYTXXXXEEWVKYVDDLELSA

SEQ ID NO: 808 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFXYTXXXXEEWVKYVDDLELSA

SEQ ID NO: 809 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFXYTXXXXEEWVKYVDDLELSA

SEQ ID NO: 810 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFXYTXXXXEEWVKYVDDLELSA

SEQ ID NO: 811 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFXYTXXXXEEWVKYVDDLELSA

SEQ ID NO: 812 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFXYTXXXXEEWVKYVDDLELSA

SEQ ID NO: 813 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFXYTXXXXEEWVKYVDDLELSA

SEQ ID NO: 814 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFXYTXXXXEEWVKYVDDLELSA

SEQ ID NO: 815 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFXYTXXXXEEWVKYVDDLELSA

SEQ ID NO: 816 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSXTXXXXEEWVKYVDDLELSA

SEQ ID NO: 817 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSXTXXXXEEWVKYVDDLELSA

SEQ ID NO: 818 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSXTXXXXEEWVKYVDDLELSA

SEQ ID NO: 819 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSXTXXXXEEWVKYVDDLELSA

SEQ ID NO: 820 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSXTXXXXEEWVKYVDDLELSA

SEQ ID NO: 821 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSXTXXXXEEWVKYVDDLELSA

SEQ ID NO: 822 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSXTXXXXEEWVKYVDDLELSA

SEQ ID NO: 823 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSXTXXXXEEWVKYVDDLELSA

SEQ ID NO: 824 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSXTXXXXEEWVKYVDDLELSA

SEQ ID NO: 825 - protein, 32 aa, Artificial Sequence
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPTXXFSYXXXXXEEWVKYVDDLELSA

SEQ ID NO: 826 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLAADTPTXXFSYXXXXXEEWVKYVDDLELSA

SEQ ID NO: 827 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXAADTPTXXFSYXXXXXEEWVKYVDDLELSA

SEQ ID NO: 828 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLXADTPTXXFSYXXXXXEEWVKYVDDLELSA

SEQ ID NO: 829 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAXDTPTXXFSYXXXXXEEWVKYVDDLELSA

SEQ ID NO: 830 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAAXTPTXXFSYXXXXXEEWVKYVDDLELSA

SEQ ID NO: 831 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADXPTXXFSYXXXXXEEWVKYVDDLELSA

SEQ ID NO: 832 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTXTXXFSYXXXXXEEWVKYVDDLELSA

SEQ ID NO: 833 - protein, 32 aa, Artificial Sequence
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SLAADTPXXXFSYXXXXXEEWVKYVDDLELSA

SEQ ID NO: 834 - protein, 23 aa, Artificial Sequence
  Description of Artificial Sequence: Synthetic peptide
  c-term may be amidated
ACFSYTSRQIPQNADYFETSSQC

SEQ ID NO: 835 - protein, 23 aa, Artificial Sequence
  Description of Artificial Sequence: Synthetic peptide
  c-term may be amidated
AKFSYTSRQIPQNADYFETSSQE

SEQ ID NO: 836 - protein, 32 aa, Artificial Sequence; identical to SEQ ID NO: 788
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 837 - protein, 32 aa, Artificial Sequence; identical to SEQ ID NO: 789
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 838 - protein, 32 aa, Artificial Sequence; identical to SEQ ID NO: 790
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 839 - protein, 32 aa, Artificial Sequence; identical to SEQ ID NO: 791
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 840 - protein, 32 aa, Artificial Sequence; identical to SEQ ID NO: 792
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 841 - protein, 32 aa, Artificial Sequence; identical to SEQ ID NO: 793
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 842 - protein, 32 aa, Artificial Sequence; identical to SEQ ID NO: 794
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 843 - protein, 32 aa, Artificial Sequence; identical to SEQ ID NO: 795
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 844 - protein, 32 aa, Artificial Sequence; identical to SEQ ID NO: 796
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 845 - protein, 32 aa, Artificial Sequence; identical to SEQ ID NO: 797
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 846 - protein, 32 aa, Artificial Sequence; identical to SEQ ID NO: 798
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 847 - protein, 32 aa, Artificial Sequence; identical to SEQ ID NO: 799
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 848 - protein, 32 aa, Artificial Sequence; identical to SEQ ID NO: 800
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 849 - protein, 32 aa, Artificial Sequence; identical to SEQ ID NO: 801
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 850 - protein, 32 aa, Artificial Sequence; identical to SEQ ID NO: 802
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 851 - protein, 32 aa, Artificial Sequence; identical to SEQ ID NO: 803
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 852 - protein, 32 aa, Artificial Sequence; identical to SEQ ID NO: 804
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 853 - protein, 32 aa, Artificial Sequence; identical to SEQ ID NO: 805
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 854 - protein, 32 aa, Artificial Sequence; identical to SEQ ID NO: 806
  Description of Artificial Sequence: Synthetic peptide
  MOD_RES (8)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 855 - protein, 32 aa, Artificial Sequence; identical to SEQ ID NO: 807
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 856 - protein, 32 aa, Artificial Sequence; identical to SEQ ID NO: 808
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 857 - protein, 32 aa, Artificial Sequence; identical to SEQ ID NO: 809
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 858 - protein, 32 aa, Artificial Sequence; identical to SEQ ID NO: 810
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 859 - protein, 32 aa, Artificial Sequence; identical to SEQ ID NO: 811
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 860 - protein, 32 aa, Artificial Sequence; identical to SEQ ID NO: 812
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 861 - protein, 32 aa, Artificial Sequence; identical to SEQ ID NO: 813
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 862 - protein, 32 aa, Artificial Sequence; identical to SEQ ID NO: 814
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 863 - protein, 32 aa, Artificial Sequence; identical to SEQ ID NO: 815
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 864 - protein, 32 aa, Artificial Sequence; identical to SEQ ID NO: 816
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 865 - protein, 32 aa, Artificial Sequence; identical to SEQ ID NO: 817
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 866 - protein, 32 aa, Artificial Sequence; identical to SEQ ID NO: 818
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 867 - protein, 32 aa, Artificial Sequence; identical to SEQ ID NO: 819
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 868 - protein, 32 aa, Artificial Sequence; identical to SEQ ID NO: 820
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 869 - protein, 32 aa, Artificial Sequence; identical to SEQ ID NO: 821
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 870 - protein, 32 aa, Artificial Sequence; identical to SEQ ID NO: 822
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 871 - protein, 32 aa, Artificial Sequence; identical to SEQ ID NO: 823
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 872 - protein, 32 aa, Artificial Sequence; identical to SEQ ID NO: 824
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 873 - protein, 32 aa, Artificial Sequence; identical to SEQ ID NO: 825
  Description of Artificial Sequence: Synthetic peptide
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 874 - protein, 32 aa, Artificial Sequence; identical to SEQ ID NO: 826
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 875 - protein, 32 aa, Artificial Sequence; identical to SEQ ID NO: 827
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 876 - protein, 32 aa, Artificial Sequence; identical to SEQ ID NO: 828
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 877 - protein, 32 aa, Artificial Sequence; identical to SEQ ID NO: 829
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 878 - protein, 32 aa, Artificial Sequence; identical to SEQ ID NO: 830
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 879 - protein, 32 aa, Artificial Sequence; identical to SEQ ID NO: 831
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 880 - protein, 32 aa, Artificial Sequence; identical to SEQ ID NO: 832
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (9)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 881 - protein, 32 aa, Artificial Sequence; identical to SEQ ID NO: 833
  Description of Artificial Sequence: Synthetic peptide
  MOD_RES (8)..(10): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 882 - protein, 9 aa, Artificial Sequence
  Description of Artificial Sequence: Synthetic peptide
  c-term may be amidated
SPYSSDTTP

SEQ ID NO: 883 - protein, 23 aa, Artificial Sequence
  Description of Artificial Sequence: Synthetic peptide
  c-term may be amidated
AFAYIARPLPRAHIKEYFYTSGK

SEQ ID NO: 884 - protein, 15 aa, Artificial Sequence
  Description of Artificial Sequence: Synthetic peptide
  c-term may be amidated
SNPAVVFVTRKNRQV

SEQ ID NO: 885 - protein, 33 aa, Artificial Sequence
  Description of Artificial Sequence: Synthetic peptide
  c-term may be amidated
SPYSSDTTPCCFAYIARPLPRAHIKEYFYTSGK

SEQ ID NO: 886 - protein, 18 aa, Artificial Sequence
  Description of Artificial Sequence: Synthetic peptide
  c-term may be amidated
ANPEKKWVREYINSLEMS

SEQ ID NO: 887 - protein, 33 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTPCCFAYXXXXEKKWVREYINSLEMS

SEQ ID NO: 888 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPYSSDTTPXXFAYXXXXEKKWVREYINSLEMS

SEQ ID NO: 889 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXYSSDTTPXXFAYXXXXEKKWVREYINSLEMS

SEQ ID NO: 890 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPXSSDTTPXXFAYXXXXEKKWVREYINSLEMS

SEQ ID NO: 891 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYXSDTTPXXFAYXXXXEKKWVREYINSLEMS

SEQ ID NO: 892 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSXDTTPXXFAYXXXXEKKWVREYINSLEMS

SEQ ID NO: 893 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSXTTPXXFAYXXXXEKKWVREYINSLEMS

SEQ ID NO: 894 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDXTPXXFAYXXXXEKKWVREYINSLEMS

SEQ ID NO: 895 - protein, 33 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTXPXXFAYXXXXEKKWVREYINSLEMS

SEQ ID NO: 896 - protein, 33 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTXXXFAYXXXXEKKWVREYINSLEMS

SEQ ID NO: 897 - protein, 33 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTPCCXAYXXXXEKKWVREYINSLEMS

SEQ ID NO: 898 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPYSSDTTPXXXAYXXXXEKKWVREYINSLEMS

SEQ ID NO: 899 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXYSSDTTPXXXAYXXXXEKKWVREYINSLEMS

SEQ ID NO: 900 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPXSSDTTPXXXAYXXXXEKKWVREYINSLEMS

SEQ ID NO: 901 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYXSDTTPXXXAYXXXXEKKWVREYINSLEMS

SEQ ID NO: 902 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSXDTTPXXXAYXXXXEKKWVREYINSLEMS

SEQ ID NO: 903 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSXTTPXXXAYXXXXEKKWVREYINSLEMS

SEQ ID NO: 904 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDXTPXXXAYXXXXEKKWVREYINSLEMS

SEQ ID NO: 905 - protein, 33 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTXPXXXAYXXXXEKKWVREYINSLEMS

SEQ ID NO: 906 - protein, 33 aa, Artificial Sequence
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTXXXXAYXXXXEKKWVREYINSLEMS

SEQ ID NO: 907 - protein, 33 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTPCCFXYXXXXEKKWVREYINSLEMS

SEQ ID NO: 908 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPYSSDTTPXXFXYXXXXEKKWVREYINSLEMS

SEQ ID NO: 909 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXYSSDTTPXXFXYXXXXEKKWVREYINSLEMS

SEQ ID NO: 910 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPXSSDTTPXXFXYXXXXEKKWVREYINSLEMS

SEQ ID NO: 911 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYXSDTTPXXFXYXXXXEKKWVREYINSLEMS

SEQ ID NO: 912 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSXDTTPXXFXYXXXXEKKWVREYINSLEMS

SEQ ID NO: 913 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSXTTPXXFXYXXXXEKKWVREYINSLEMS

SEQ ID NO: 914 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDXTPXXFXYXXXXEKKWVREYINSLEMS

SEQ ID NO: 915 - protein, 33 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTXPXXFXYXXXXEKKWVREYINSLEMS

SEQ ID NO: 916 - protein, 33 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTXXXFXYXXXXEKKWVREYINSLEMS

SEQ ID NO: 917 - protein, 33 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTPCCFAXXXXXEKKWVREYINSLEMS

SEQ ID NO: 918 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPYSSDTTPXXFAXXXXXEKKWVREYINSLEMS

SEQ ID NO: 919 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SXYSSDTTPXXFAXXXXXEKKWVREYINSLEMS

SEQ ID NO: 920 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPXSSDTTPXXFAXXXXXEKKWVREYINSLEMS

SEQ ID NO: 921 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYXSDTTPXXFAXXXXXEKKWVREYINSLEMS

SEQ ID NO: 922 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSXDTTPXXFAXXXXXEKKWVREYINSLEMS

SEQ ID NO: 923 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSXTTPXXFAXXXXXEKKWVREYINSLEMS

SEQ ID NO: 924 - protein, 33 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDXTPXXFAXXXXXEKKWVREYINSLEMS

SEQ ID NO: 925 - protein, 33 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTXPXXFAXXXXXEKKWVREYINSLEMS

SEQ ID NO: 926 - protein, 33 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
SPYSSDTTXXXFAXXXXXEKKWVREYINSLEMS

SEQ ID NO: 927 - protein, 25 aa, Artificial Sequence
  Description of Artificial Sequence: Synthetic peptide
  c-term may be amidated
ACFAYIARPLPRAHIKEYFYTSGKC

SEQ ID NO: 928 - protein, 24 aa, Artificial Sequence
  Description of Artificial Sequence: Synthetic peptide
  c-term may be amidated
ECFAYIARPLPRAHIKEYFYTSGK

SEQ ID NO: 929 - protein, 24 aa, Artificial Sequence
  Description of Artificial Sequence: Synthetic peptide
  c-term may be amidated
ACFAYIARPLPRAHIKEYFYTSGK

SEQ ID NO: 930 - protein, 33 aa, Artificial Sequence; identical to SEQ ID NO: 885
  Description of Artificial Sequence: Synthetic peptide
  c-term may be amidated

SEQ ID NO: 931 - protein, 33 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  c-term may be amidated
SPYSSDTTPXXFAYIARPLPRAHIKEYFYTSGK

SEQ ID NO: 932 - protein, 33 aa, Artificial Sequence; identical to SEQ ID NO: 887
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 933 - protein, 33 aa, Artificial Sequence; identical to SEQ ID NO: 888
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 934 - protein, 33 aa, Artificial Sequence; identical to SEQ ID NO: 889
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 935 - protein, 33 aa, Artificial Sequence; identical to SEQ ID NO: 890
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 936 - protein, 33 aa, Artificial Sequence; identical to SEQ ID NO: 891
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 937 - protein, 33 aa, Artificial Sequence; identical to SEQ ID NO: 892
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 938 - protein, 33 aa, Artificial Sequence; identical to SEQ ID NO: 893
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 939 - protein, 33 aa, Artificial Sequence; identical to SEQ ID NO: 894
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 940 - protein, 33 aa, Artificial Sequence; identical to SEQ ID NO: 895
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 941 - protein, 33 aa, Artificial Sequence; identical to SEQ ID NO: 896
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 942 - protein, 33 aa, Artificial Sequence; identical to SEQ ID NO: 897
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 943 - protein, 33 aa, Artificial Sequence; identical to SEQ ID NO: 898
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 944 - protein, 33 aa, Artificial Sequence; identical to SEQ ID NO: 899
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 945 - protein, 33 aa, Artificial Sequence; identical to SEQ ID NO: 900
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 946 - protein, 33 aa, Artificial Sequence; identical to SEQ ID NO: 901
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 947 - protein, 33 aa, Artificial Sequence; identical to SEQ ID NO: 902
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 948 - protein, 33 aa, Artificial Sequence; identical to SEQ ID NO: 903
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 949 - protein, 33 aa, Artificial Sequence; identical to SEQ ID NO: 904
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 950 - protein, 33 aa, Artificial Sequence; identical to SEQ ID NO: 905
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 951 - protein, 33 aa, Artificial Sequence; identical to SEQ ID NO: 906
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 952 - protein, 33 aa, Artificial Sequence; identical to SEQ ID NO: 907
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 953 - protein, 33 aa, Artificial Sequence; identical to SEQ ID NO: 908
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 954 - protein, 33 aa, Artificial Sequence; identical to SEQ ID NO: 909
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 955 - protein, 33 aa, Artificial Sequence; identical to SEQ ID NO: 910
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 956 - protein, 33 aa, Artificial Sequence; identical to SEQ ID NO: 911
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 957 - protein, 33 aa, Artificial Sequence; identical to SEQ ID NO: 912
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 958 - protein, 33 aa, Artificial Sequence; identical to SEQ ID NO: 913
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 959 - protein, 33 aa, Artificial Sequence; identical to SEQ ID NO: 914
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 960 - protein, 33 aa, Artificial Sequence; identical to SEQ ID NO: 915
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 961 - protein, 33 aa, Artificial Sequence; identical to SEQ ID NO: 916
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 962 - protein, 33 aa, Artificial Sequence; identical to SEQ ID NO: 917
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 963 - protein, 33 aa, Artificial Sequence; identical to SEQ ID NO: 918
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 964 - protein, 33 aa, Artificial Sequence; identical to SEQ ID NO: 919
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 965 - protein, 33 aa, Artificial Sequence; identical to SEQ ID NO: 920
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 966 - protein, 33 aa, Artificial Sequence; identical to SEQ ID NO: 921
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 967 - protein, 33 aa, Artificial Sequence; identical to SEQ ID NO: 922
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 968 - protein, 33 aa, Artificial Sequence; identical to SEQ ID NO: 923
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 969 - protein, 33 aa, Artificial Sequence; identical to SEQ ID NO: 924
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 970 - protein, 33 aa, Artificial Sequence; identical to SEQ ID NO: 925
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 971 - protein, 33 aa, Artificial Sequence; identical to SEQ ID NO: 926
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 972 - protein, 10 aa, Artificial Sequence
  Description of Artificial Sequence: Synthetic peptide
  c-term may be amidated
KSMQVPFSRA

SEQ ID NO: 973 - protein, 15 aa, Artificial Sequence
  Description of Artificial Sequence: Synthetic peptide
  c-term may be amidated
AFSFAEQEIPLRAIL

SEQ ID NO: 974 - protein, 23 aa, Artificial Sequence
  Description of Artificial Sequence: Synthetic peptide
  c-term may be amidated
AFSFAEQEIPLRAILCYRNTSSI

SEQ ID NO: 975 - protein, 24 aa, Artificial Sequence
  Description of Artificial Sequence: Synthetic peptide
  c-term may be amidated
AYRNTSSICSNEGLIFKLKRGKEA

SEQ ID NO: 976 - protein, 25 aa, Artificial Sequence
  Description of Artificial Sequence: Synthetic peptide
  c-term may be amidated
KSMQVPFSRCCFSFAEQEIPLRAIL

SEQ ID NO: 977 - protein, 25 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  c-term may be amidated
KSMQVPFSRXXFSFAEQEIPLRAIL

SEQ ID NO: 978 - protein, 25 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
XSMQVPFSRXXFSFAEQEIPLRAIL

SEQ ID NO: 979 - protein, 25 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KXMQVPFSRXXFSFAEQEIPLRAIL

SEQ ID NO: 980 - protein, 25 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSXQVPFSRXXFSFAEQEIPLRAIL

SEQ ID NO: 981 - protein, 25 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSMXVPFSRXXFSFAEQEIPLRAIL

SEQ ID NO: 982 - protein, 25 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSMQXPFSRXXFSFAEQEIPLRAIL

SEQ ID NO: 983 - protein, 25 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSMQVXFSRXXFSFAEQEIPLRAIL

SEQ ID NO: 984 - protein, 25 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSMQVPXSRXXFSFAEQEIPLRAIL

SEQ ID NO: 985 - protein, 25 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  c-term may be amidated
KSMQVPFXRXXFSFAEQEIPLRAIL

SEQ ID NO: 986 - protein, 25 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  c-term may be amidated
KSMQVPFSXXXFSFAEQEIPLRAIL

SEQ ID NO: 987 - protein, 34 aa, Artificial Sequence
  Description of Artificial Sequence: Synthetic peptide
  c-term may be amidated
ASNEGLIFKLKRGKEACALDTVGWVQRHRKMLRH

SEQ ID NO: 988 - protein, 24 aa, Artificial Sequence
  Description of Artificial Sequence: Synthetic peptide
  c-term may be amidated
AALDTVGWVQRHRKMLRHCPSKRK

SEQ ID NO: 989 - protein, 31 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFXXXXTVGWVQRHRKMLR

SEQ ID NO: 990 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFXXXXTVGWVQRHRKMLR

SEQ ID NO: 991 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFXXXXTVGWVQRHRKMLR

SEQ ID NO: 992 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFXXXXTVGWVQRHRKMLR

SEQ ID NO: 993 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFXXXXTVGWVQRHRKMLR

SEQ ID NO: 994 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFXXXXTVGWVQRHRKMLR

SEQ ID NO: 995 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFXXXXTVGWVQRHRKMLR

SEQ ID NO: 996 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFXXXXTVGWVQRHRKMLR

SEQ ID NO: 997 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFXXXXTVGWVQRHRKMLR

SEQ ID NO: 998 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFXXXXTVGWVQRHRKMLR

SEQ ID NO: 999 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFXXXXTVGWVQRHRKMLR

SEQ ID NO: 1000 - protein, 31 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCXSFXXXXTVGWVQRHRKMLR

SEQ ID NO: 1001 - protein, 31 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXXSFXXXXTVGWVQRHRKMLR

SEQ ID NO: 1002 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXXSFXXXXTVGWVQRHRKMLR

SEQ ID NO: 1003 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXXSFXXXXTVGWVQRHRKMLR

SEQ ID NO: 1004 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXXSFXXXXTVGWVQRHRKMLR

SEQ ID NO: 1005 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXXSFXXXXTVGWVQRHRKMLR

SEQ ID NO: 1006 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXXSFXXXXTVGWVQRHRKMLR

SEQ ID NO: 1007 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXXSFXXXXTVGWVQRHRKMLR

SEQ ID NO: 1008 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXXSFXXXXTVGWVQRHRKMLR

SEQ ID NO: 1009 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXXSFXXXXTVGWVQRHRKMLR

SEQ ID NO: 1010 - protein, 31 aa, Artificial Sequence
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXXSFXXXXTVGWVQRHRKMLR

SEQ ID NO: 1011 - protein, 31 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFXFXXXXTVGWVQRHRKMLR

SEQ ID NO: 1012 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFXFXXXXTVGWVQRHRKMLR

SEQ ID NO: 1013 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFXFXXXXTVGWVQRHRKMLR

SEQ ID NO: 1014 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFXFXXXXTVGWVQRHRKMLR

SEQ ID NO: 1015 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFXFXXXXTVGWVQRHRKMLR

SEQ ID NO: 1016 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFXFXXXXTVGWVQRHRKMLR

SEQ ID NO: 1017 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFXFXXXXTVGWVQRHRKMLR

SEQ ID NO: 1018 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFXFXXXXTVGWVQRHRKMLR

SEQ ID NO: 1019 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFXFXXXXTVGWVQRHRKMLR

SEQ ID NO: 1020 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFXFXXXXTVGWVQRHRKMLR

SEQ ID NO: 1021 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFXFXXXXTVGWVQRHRKMLR

SEQ ID NO: 1022 - protein, 31 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSXXXXXTVGWVQRHRKMLR

SEQ ID NO: 1023 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSXXXXXTVGWVQRHRKMLR

SEQ ID NO: 1024 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSXXXXXTVGWVQRHRKMLR

SEQ ID NO: 1025 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSXXXXXTVGWVQRHRKMLR

SEQ ID NO: 1026 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSXXXXXTVGWVQRHRKMLR

SEQ ID NO: 1027 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSXXXXXTVGWVQRHRKMLR

SEQ ID NO: 1028 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSXXXXXTVGWVQRHRKMLR

SEQ ID NO: 1029 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSXXXXXTVGWVQRHRKMLR

SEQ ID NO: 1030 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSXXXXXTVGWVQRHRKMLR

SEQ ID NO: 1031 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSXXXXXTVGWVQRHRKMLR

SEQ ID NO: 1032 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSXXXXXTVGWVQRHRKMLR

SEQ ID NO: 1033 - protein, 34 aa, Artificial Sequence
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAEQXXXXTVGWVQRHRKMLR

SEQ ID NO: 1034 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAEQXXXXTVGWVQRHRKMLR

SEQ ID NO: 1035 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAEQXXXXTVGWVQRHRKMLR

SEQ ID NO: 1036 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAEQXXXXTVGWVQRHRKMLR

SEQ ID NO: 1037 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAEQXXXXTVGWVQRHRKMLR

SEQ ID NO: 1038 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAEQXXXXTVGWVQRHRKMLR

SEQ ID NO: 1039 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFAEQXXXXTVGWVQRHRKMLR

SEQ ID NO: 1040 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFAEQXXXXTVGWVQRHRKMLR

SEQ ID NO: 1041 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFAEQXXXXTVGWVQRHRKMLR

SEQ ID NO: 1042 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFAEQXXXXTVGWVQRHRKMLR

SEQ ID NO: 1043 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFAEQXXXXTVGWVQRHRKMLR

SEQ ID NO: 1044 - protein, 34 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCXSFAEQXXXXTVGWVQRHRKMLR

SEQ ID NO: 1045 - protein, 34 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXXSFAEQXXXXTVGWVQRHRKMLR

SEQ ID NO: 1046 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXXSFAEQXXXXTVGWVQRHRKMLR

SEQ ID NO: 1047 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXXSFAEQXXXXTVGWVQRHRKMLR

SEQ ID NO: 1048 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXXSFAEQXXXXTVGWVQRHRKMLR

SEQ ID NO: 1049 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXXSFAEQXXXXTVGWVQRHRKMLR

SEQ ID NO: 1050 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXXSFAEQXXXXTVGWVQRHRKMLR

SEQ ID NO: 1051 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXXSFAEQXXXXTVGWVQRHRKMLR

SEQ ID NO: 1052 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXXSFAEQXXXXTVGWVQRHRKMLR

SEQ ID NO: 1053 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXXSFAEQXXXXTVGWVQRHRKMLR

SEQ ID NO: 1054 - protein, 34 aa, Artificial Sequence
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXXSFAEQXXXXTVGWVQRHRKMLR

SEQ ID NO: 1055 - protein, 34 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFXFAEQXXXXTVGWVQRHRKMLR

SEQ ID NO: 1056 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFXFAEQXXXXTVGWVQRHRKMLR

SEQ ID NO: 1057 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFXFAEQXXXXTVGWVQRHRKMLR

SEQ ID NO: 1058 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFXFAEQXXXXTVGWVQRHRKMLR

SEQ ID NO: 1059 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFXFAEQXXXXTVGWVQRHRKMLR

SEQ ID NO: 1060 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFXFAEQXXXXTVGWVQRHRKMLR

SEQ ID NO: 1061 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFXFAEQXXXXTVGWVQRHRKMLR

SEQ ID NO: 1062 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFXFAEQXXXXTVGWVQRHRKMLR

SEQ ID NO: 1063 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFXFAEQXXXXTVGWVQRHRKMLR

SEQ ID NO: 1064 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFXFAEQXXXXTVGWVQRHRKMLR

SEQ ID NO: 1065 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFXFAEQXXXXTVGWVQRHRKMLR

SEQ ID NO: 1066 - protein, 34 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSXAEQXXXXTVGWVQRHRKMLR

SEQ ID NO: 1067 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSXAEQXXXXTVGWVQRHRKMLR

SEQ ID NO: 1068 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSXAEQXXXXTVGWVQRHRKMLR

SEQ ID NO: 1069 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSXAEQXXXXTVGWVQRHRKMLR

SEQ ID NO: 1070 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSXAEQXXXXTVGWVQRHRKMLR

SEQ ID NO: 1071 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSXAEQXXXXTVGWVQRHRKMLR

SEQ ID NO: 1072 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSXAEQXXXXTVGWVQRHRKMLR

SEQ ID NO: 1073 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSXAEQXXXXTVGWVQRHRKMLR

SEQ ID NO: 1074 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSXAEQXXXXTVGWVQRHRKMLR

SEQ ID NO: 1075 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSXAEQXXXXTVGWVQRHRKMLR

SEQ ID NO: 1076 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSXAEQXXXXTVGWVQRHRKMLR

SEQ ID NO: 1077 - protein, 34 aa, Artificial Sequence
  Description of Artificial Sequence: Synthetic peptide
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFXEQXXXXTVGWVQRHRKMLR

SEQ ID NO: 1078 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFXEQXXXXTVGWVQRHRKMLR

SEQ ID NO: 1079 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFXEQXXXXTVGWVQRHRKMLR

SEQ ID NO: 1080 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFXEQXXXXTVGWVQRHRKMLR

SEQ ID NO: 1081 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFXEQXXXXTVGWVQRHRKMLR

SEQ ID NO: 1082 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFXEQXXXXTVGWVQRHRKMLR

SEQ ID NO: 1083 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFXEQXXXXTVGWVQRHRKMLR

SEQ ID NO: 1084 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFXEQXXXXTVGWVQRHRKMLR

SEQ ID NO: 1085 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFXEQXXXXTVGWVQRHRKMLR

SEQ ID NO: 1086 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFXEQXXXXTVGWVQRHRKMLR

SEQ ID NO: 1087 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFXEQXXXXTVGWVQRHRKMLR

SEQ ID NO: 1088 - protein, 34 aa, Artificial Sequence
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAXQXXXXTVGWVQRHRKMLR

SEQ ID NO: 1089 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAXQXXXXTVGWVQRHRKMLR

SEQ ID NO: 1090 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAXQXXXXTVGWVQRHRKMLR

SEQ ID NO: 1091 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAXQXXXXTVGWVQRHRKMLR

SEQ ID NO: 1092 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAXQXXXXTVGWVQRHRKMLR

SEQ ID NO: 1093 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAXQXXXXTVGWVQRHRKMLR

SEQ ID NO: 1094 - protein, 34 aa, Artificial Sequence
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAEXXXXXTVGWVQRHRKMLR

SEQ ID NO: 1095 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAEXXXXXTVGWVQRHRKMLR

SEQ ID NO: 1096 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAEXXXXXTVGWVQRHRKMLR

SEQ ID NO: 1097 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAEXXXXXTVGWVQRHRKMLR

SEQ ID NO: 1098 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAEXXXXXTVGWVQRHRKMLR

SEQ ID NO: 1099 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAEXXXXXTVGWVQRHRKMLR

SEQ ID NO: 1100 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFAEXXXXXTVGWVQRHRKMLR

SEQ ID NO: 1101 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFAEXXXXXTVGWVQRHRKMLR

SEQ ID NO: 1102 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFAEXXXXXTVGWVQRHRKMLR

SEQ ID NO: 1103 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFAEXXXXXTVGWVQRHRKMLR

SEQ ID NO: 1104 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFAEXXXXXTVGWVQRHRKMLR

SEQ ID NO: 1105 - protein, 31 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFXXXXTVGWVERHRKMLR

SEQ ID NO: 1106 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFXXXXTVGWVERHRKMLR

SEQ ID NO: 1107 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFXXXXTVGWVERHRKMLR

SEQ ID NO: 1108 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFXXXXTVGWVERHRKMLR

SEQ ID NO: 1109 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFXXXXTVGWVERHRKMLR

SEQ ID NO: 1110 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFXXXXTVGWVERHRKMLR

SEQ ID NO: 1111 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFXXXXTVGWVERHRKMLR

SEQ ID NO: 1112 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFXXXXTVGWVERHRKMLR

SEQ ID NO: 1113 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFXXXXTVGWVERHRKMLR

SEQ ID NO: 1114 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFXXXXTVGWVERHRKMLR

SEQ ID NO: 1115 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFXXXXTVGWVERHRKMLR

SEQ ID NO: 1116 - protein, 31 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCXSFXXXXTVGWVERHRKMLR

SEQ ID NO: 1117 - protein, 31 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXXSFXXXXTVGWVERHRKMLR

SEQ ID NO: 1118 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXXSFXXXXTVGWVERHRKMLR

SEQ ID NO: 1119 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXXSFXXXXTVGWVERHRKMLR

SEQ ID NO: 1120 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXXSFXXXXTVGWVERHRKMLR

SEQ ID NO: 1121 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXXSFXXXXTVGWVERHRKMLR

SEQ ID NO: 1122 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXXSFXXXXTVGWVERHRKMLR

SEQ ID NO: 1123 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXXSFXXXXTVGWVERHRKMLR

SEQ ID NO: 1124 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXXSFXXXXTVGWVERHRKMLR

SEQ ID NO: 1125 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXXSFXXXXTVGWVERHRKMLR

SEQ ID NO: 1126 - protein, 31 aa, Artificial Sequence
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXXSFXXXXTVGWVERHRKMLR

SEQ ID NO: 1127 - protein, 31 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFXFXXXXTVGWVERHRKMLR

SEQ ID NO: 1128 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFXFXXXXTVGWVERHRKMLR

SEQ ID NO: 1129 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFXFXXXXTVGWVERHRKMLR

SEQ ID NO: 1130 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFXFXXXXTVGWVERHRKMLR

SEQ ID NO: 1131 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFXFXXXXTVGWVERHRKMLR

SEQ ID NO: 1132 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFXFXXXXTVGWVERHRKMLR

SEQ ID NO: 1133 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFXFXXXXTVGWVERHRKMLR

SEQ ID NO: 1134 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFXFXXXXTVGWVERHRKMLR

SEQ ID NO: 1135 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFXFXXXXTVGWVERHRKMLR

SEQ ID NO: 1136 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFXFXXXXTVGWVERHRKMLR

SEQ ID NO: 1137 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFXFXXXXTVGWVERHRKMLR

SEQ ID NO: 1138 - protein, 31 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSXXXXXTVGWVERHRKMLR

SEQ ID NO: 1139 - protein, 31 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSXXXXXTVGWVERHRKMLR

SEQ ID NO: 1140 - protein, 31 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSXXXXXTVGWVERHRKMLR

SEQ ID NO: 1141 - protein, 31 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSXXXXXTVGWVERHRKMLR

SEQ ID NO: 1142 - protein, 31 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSXXXXXTVGWVERHRKMLR

SEQ ID NO: 1143 - protein, 31 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSXXXXXTVGWVERHRKMLR

SEQ ID NO: 1144 - protein, 31 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSXXXXXTVGWVERHRKMLR

SEQ ID NO: 1145 - protein, 31 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSXXXXXTVGWVERHRKMLR

SEQ ID NO: 1146 - protein, 31 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSXXXXXTVGWVERHRKMLR

SEQ ID NO: 1147 - protein, 31 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSXXXXXTVGWVERHRKMLR

SEQ ID NO: 1148 - protein, 31 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSXXXXXTVGWVERHRKMLR

SEQ ID NO: 1149 - protein, 34 aa, Artificial Sequence
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAEQXXXXTVGWVERHRKMLR

SEQ ID NO: 1150 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAEQXXXXTVGWVERHRKMLR

SEQ ID NO: 1151 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAEQXXXXTVGWVERHRKMLR

SEQ ID NO: 1152 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAEQXXXXTVGWVERHRKMLR

SEQ ID NO: 1153 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAEQXXXXTVGWVERHRKMLR

SEQ ID NO: 1154 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAEQXXXXTVGWVERHRKMLR

SEQ ID NO: 1155 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFAEQXXXXTVGWVERHRKMLR

SEQ ID NO: 1156 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFAEQXXXXTVGWVERHRKMLR

SEQ ID NO: 1157 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFAEQXXXXTVGWVERHRKMLR

SEQ ID NO: 1158 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFAEQXXXXTVGWVERHRKMLR

SEQ ID NO: 1159 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFAEQXXXXTVGWVERHRKMLR

SEQ ID NO: 1160 - protein, 34 aa, Artificial Sequence
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCXSFAEQXXXXTVGWVERHRKMLR

SEQ ID NO: 1161 - protein, 34 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXXSFAEQXXXXTVGWVERHRKMLR

SEQ ID NO: 1162 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXXSFAEQXXXXTVGWVERHRKMLR

SEQ ID NO: 1163 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXXSFAEQXXXXTVGWVERHRKMLR

SEQ ID NO: 1164 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXXSFAEQXXXXTVGWVERHRKMLR

SEQ ID NO: 1165 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXXSFAEQXXXXTVGWVERHRKMLR

SEQ ID NO: 1166 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXXSFAEQXXXXTVGWVERHRKMLR

SEQ ID NO: 1167 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXXSFAEQXXXXTVGWVERHRKMLR

SEQ ID NO: 1168 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXXSFAEQXXXXTVGWVERHRKMLR

SEQ ID NO: 1169 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXXSFAEQXXXXTVGWVERHRKMLR

SEQ ID NO: 1170 - protein, 34 aa, Artificial Sequence
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXXSFAEQXXXXTVGWVERHRKMLR

SEQ ID NO: 1171 - protein, 34 aa, Artificial Sequence
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFXFAEQXXXXTVGWVERHRKMLR

SEQ ID NO: 1172 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFXFAEQXXXXTVGWVERHRKMLR

SEQ ID NO: 1173 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFXFAEQXXXXTVGWVERHRKMLR

SEQ ID NO: 1174 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFXFAEQXXXXTVGWVERHRKMLR

SEQ ID NO: 1175 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFXFAEQXXXXTVGWVERHRKMLR

SEQ ID NO: 1176 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFXFAEQXXXXTVGWVERHRKMLR

SEQ ID NO: 1177 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFXFAEQXXXXTVGWVERHRKMLR

SEQ ID NO: 1178 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFXFAEQXXXXTVGWVERHRKMLR

SEQ ID NO: 1179 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFXFAEQXXXXTVGWVERHRKMLR

SEQ ID NO: 1180 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFXFAEQXXXXTVGWVERHRKMLR

SEQ ID NO: 1181 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFXFAEQXXXXTVGWVERHRKMLR

SEQ ID NO: 1182 - protein, 34 aa, Artificial Sequence
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSXAEQXXXXTVGWVERHRKMLR

SEQ ID NO: 1183 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSXAEQXXXXTVGWVERHRKMLR

SEQ ID NO: 1184 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSXAEQXXXXTVGWVERHRKMLR

SEQ ID NO: 1185 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSXAEQXXXXTVGWVERHRKMLR

SEQ ID NO: 1186 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSXAEQXXXXTVGWVERHRKMLR

SEQ ID NO: 1187 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSXAEQXXXXTVGWVERHRKMLR

SEQ ID NO: 1188 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSXAEQXXXXTVGWVERHRKMLR

SEQ ID NO: 1189 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSXAEQXXXXTVGWVERHRKMLR

SEQ ID NO: 1190 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSXAEQXXXXTVGWVERHRKMLR

SEQ ID NO: 1191 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSXAEQXXXXTVGWVERHRKMLR

SEQ ID NO: 1192 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSXAEQXXXXTVGWVERHRKMLR

SEQ ID NO: 1193 - protein, 34 aa, Artificial Sequence
  Description of Artificial Sequence: Synthetic peptide
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFXEQXXXXTVGWVERHRKMLR

SEQ ID NO: 1194 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFXEQXXXXTVGWVERHRKMLR

SEQ ID NO: 1195 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFXEQXXXXTVGWVERHRKMLR

SEQ ID NO: 1196 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFXEQXXXXTVGWVERHRKMLR

SEQ ID NO: 1197 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFXEQXXXXTVGWVERHRKMLR

SEQ ID NO: 1198 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFXEQXXXXTVGWVERHRKMLR

SEQ ID NO: 1199 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFXEQXXXXTVGWVERHRKMLR

SEQ ID NO: 1200 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFXEQXXXXTVGWVERHRKMLR

SEQ ID NO: 1201 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFXEQXXXXTVGWVERHRKMLR

SEQ ID NO: 1202 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFXEQXXXXTVGWVERHRKMLR

SEQ ID NO: 1203 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFXEQXXXXTVGWVERHRKMLR

SEQ ID NO: 1204 - protein, 34 aa, Artificial Sequence
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAXQXXXXTVGWVERHRKMLR

SEQ ID NO: 1205 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAXQXXXXTVGWVERHRKMLR

SEQ ID NO: 1206 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAXQXXXXTVGWVERHRKMLR

SEQ ID NO: 1207 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAXQXXXXTVGWVERHRKMLR

SEQ ID NO: 1208 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAXQXXXXTVGWVERHRKMLR

SEQ ID NO: 1209 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAXQXXXXTVGWVERHRKMLR

SEQ ID NO: 1210 - protein, 34 aa, Artificial Sequence
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRCCFSFAEXXXXXTVGWVERHRKMLR

SEQ ID NO: 1211 - protein, 34 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSRXXFSFAEXXXXXTVGWVERHRKMLR

SEQ ID NO: 1212 - protein, 34 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
XSMQVPFSRXXFSFAEXXXXXTVGWVERHRKMLR

SEQ ID NO: 1213 - protein, 34 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KXMQVPFSRXXFSFAEXXXXXTVGWVERHRKMLR

SEQ ID NO: 1214 - protein, 34 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSXQVPFSRXXFSFAEXXXXXTVGWVERHRKMLR

SEQ ID NO: 1215 - protein, 34 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMXVPFSRXXFSFAEXXXXXTVGWVERHRKMLR

SEQ ID NO: 1216 - protein, 34 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQXPFSRXXFSFAEXXXXXTVGWVERHRKMLR

SEQ ID NO: 1217 - protein, 34 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVXFSRXXFSFAEXXXXXTVGWVERHRKMLR

SEQ ID NO: 1218 - protein, 34 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPXSRXXFSFAEXXXXXTVGWVERHRKMLR

SEQ ID NO: 1219 - protein, 34 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFXRXXFSFAEXXXXXTVGWVERHRKMLR

SEQ ID NO: 1220 - protein, 34 aa, Artificial Sequence
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated
KSMQVPFSXXXFSFAEXXXXXTVGWVERHRKMLR

SEQ ID NO: 1221 - protein, 24 aa, Artificial Sequence
  Description of Artificial Sequence: Synthetic peptide
  c-term may be amidated
AYRNTSSICSNEGLIFKLKRGKEA

SEQ ID NO: 1222 - protein, 24 aa, Artificial Sequence
  Description of Artificial Sequence: Synthetic peptide
  c-term may be amidated
AYRNTSSICSNEGLIFKLKRGKEA

SEQ ID NO: 1223 - protein, 24 aa, Artificial Sequence
  Description of Artificial Sequence: Synthetic peptide
  c-term may be amidated
AYRNTSSICSNEGLIFKLKRGKEA

SEQ ID NO: 1224 - protein, 25 aa, Artificial Sequence
  Description of Artificial Sequence: Synthetic peptide
  c-term may be amidated
KSMQVPFSRCCFSFAEQEIPLRAIL

SEQ ID NO: 1225 - protein, 25 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  c-term may be amidated
KSMQVPFSRXXFSFAEQEIPLRAIL

SEQ ID NO: 1226 - protein, 25 aa, Artificial Sequence
  Description of Artificial Sequence: Synthetic peptide
  c-term may be amidated
KSMQVPFSRCCFSFAEQEIPLRAIL

SEQ ID NO: 1227 - protein, 25 aa, Artificial Sequence
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  c-term may be amidated
KSMQVPFSRXXFSFAEQEIPLRAIL

SEQ ID NO: 1228 - protein, 34 aa, Artificial Sequence; identical to SEQ ID NO: 987
  Description of Artificial Sequence: Synthetic peptide
  c-term may be amidated

SEQ ID NO: 1229 - protein, 33 aa, Artificial Sequence
  Description of Artificial Sequence: Synthetic peptide
  c-term may be amidated
ASNEGLIFKLKRGKEACALDTVGWVQRHRKMLR

SEQ ID NO: 1230 - protein, 33 aa, Artificial Sequence; identical to SEQ ID NO: 1229
  Description of Artificial Sequence: Synthetic peptide
  c-term may be amidated

SEQ ID NO: 1231 - protein, 33 aa, Artificial Sequence; identical to SEQ ID NO: 1229
  Description of Artificial Sequence: Synthetic peptide
  c-term may be amidated

SEQ ID NO: 1232 - protein, 33 aa, Artificial Sequence; identical to SEQ ID NO: 1229
  Description of Artificial Sequence: Synthetic peptide
  c-term may be amidated

SEQ ID NO: 1233 - protein, 33 aa, Artificial Sequence; identical to SEQ ID NO: 1229
  Description of Artificial Sequence: Synthetic peptide
  c-term may be amidated

SEQ ID NO: 1234 - protein, 33 aa, Artificial Sequence; identical to SEQ ID NO: 1229
  Description of Artificial Sequence: Synthetic peptide
  c-term may be amidated

SEQ ID NO: 1235 - protein, 31 aa, Artificial Sequence; identical to SEQ ID NO: 1105
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1236 - protein, 31 aa, Artificial Sequence; identical to SEQ ID NO: 1106
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1237 - protein, 31 aa, Artificial Sequence; identical to SEQ ID NO: 1107
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1238 - protein, 31 aa, Artificial Sequence; identical to SEQ ID NO: 1108
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1239 - protein, 31 aa, Artificial Sequence; identical to SEQ ID NO: 1109
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1240 - protein, 31 aa, Artificial Sequence; identical to SEQ ID NO: 1110
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1241 - protein, 31 aa, Artificial Sequence; identical to SEQ ID NO: 1111
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1242 - protein, 31 aa, Artificial Sequence; identical to SEQ ID NO: 1112
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1243 - protein, 31 aa, Artificial Sequence; identical to SEQ ID NO: 1113
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1244 - protein, 31 aa, Artificial Sequence; identical to SEQ ID NO: 1114
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1245 - protein, 31 aa, Artificial Sequence; identical to SEQ ID NO: 1115
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1246 - protein, 31 aa, Artificial Sequence; identical to SEQ ID NO: 1116
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1247 - protein, 31 aa, Artificial Sequence; identical to SEQ ID NO: 1117
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1248 - protein, 31 aa, Artificial Sequence; identical to SEQ ID NO: 1118
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1249 - protein, 31 aa, Artificial Sequence; identical to SEQ ID NO: 1119
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1250 - protein, 31 aa, Artificial Sequence; identical to SEQ ID NO: 1120
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1251 - protein, 31 aa, Artificial Sequence; identical to SEQ ID NO: 1121
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1252 - protein, 31 aa, Artificial Sequence; identical to SEQ ID NO: 1122
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1253 - protein, 31 aa, Artificial Sequence; identical to SEQ ID NO: 1123
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1254 - protein, 31 aa, Artificial Sequence; identical to SEQ ID NO: 1124
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1255 - protein, 31 aa, Artificial Sequence; identical to SEQ ID NO: 1125
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1256 - protein, 31 aa, Artificial Sequence; identical to SEQ ID NO: 1126
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1257 - protein, 31 aa, Artificial Sequence; identical to SEQ ID NO: 1127
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1258 - protein, 31 aa, Artificial Sequence; identical to SEQ ID NO: 1128
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1259 - protein, 31 aa, Artificial Sequence; identical to SEQ ID NO: 1129
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1260 - protein, 31 aa, Artificial Sequence; identical to SEQ ID NO: 1130
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1261 - protein, 31 aa, Artificial Sequence; identical to SEQ ID NO: 1131
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1262 - protein, 31 aa, Artificial Sequence; identical to SEQ ID NO: 1132
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1263 - protein, 31 aa, Artificial Sequence; identical to SEQ ID NO: 1133
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1264 - protein, 31 aa, Artificial Sequence; identical to SEQ ID NO: 1134
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1265 - protein, 31 aa, Artificial Sequence; identical to SEQ ID NO: 1135
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1266 - protein, 31 aa, Artificial Sequence; identical to SEQ ID NO: 1136
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1267 - protein, 31 aa, Artificial Sequence; identical to SEQ ID NO: 1137
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1268 - protein, 31 aa, Artificial Sequence; identical to SEQ ID NO: 1138
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1269 - protein, 31 aa, Artificial Sequence; identical to SEQ ID NO: 1139
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1270 - protein, 31 aa, Artificial Sequence; identical to SEQ ID NO: 1140
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1271 - protein, 31 aa, Artificial Sequence; identical to SEQ ID NO: 1141
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1272 - protein, 31 aa, Artificial Sequence; identical to SEQ ID NO: 1142
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1273 - protein, 31 aa, Artificial Sequence; identical to SEQ ID NO: 1143
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1274 - protein, 31 aa, Artificial Sequence; identical to SEQ ID NO: 1144
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1275 - protein, 31 aa, Artificial Sequence; identical to SEQ ID NO: 1145
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1276 - protein, 31 aa, Artificial Sequence; identical to SEQ ID NO: 1146
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1277 - protein, 31 aa, Artificial Sequence; identical to SEQ ID NO: 1147
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1278 - protein, 31 aa, Artificial Sequence; identical to SEQ ID NO: 1148
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1279 - protein, 34 aa, Artificial Sequence; identical to SEQ ID NO: 1149
  Description of Artificial Sequence: Synthetic peptide
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1280 - protein, 34 aa, Artificial Sequence; identical to SEQ ID NO: 1150
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1281 - protein, 34 aa, Artificial Sequence; identical to SEQ ID NO: 1151
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1282 - protein, 34 aa, Artificial Sequence; identical to SEQ ID NO: 1152
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1283 - protein, 34 aa, Artificial Sequence; identical to SEQ ID NO: 1153
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1284 - protein, 34 aa, Artificial Sequence; identical to SEQ ID NO: 1154
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1285 - protein, 34 aa, Artificial Sequence; identical to SEQ ID NO: 1155
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1286 - protein, 34 aa, Artificial Sequence; identical to SEQ ID NO: 1156
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1287 - protein, 34 aa, Artificial Sequence; identical to SEQ ID NO: 1157
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1288 - protein, 34 aa, Artificial Sequence; identical to SEQ ID NO: 1158
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1289 - protein, 34 aa, Artificial Sequence; identical to SEQ ID NO: 1159
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1290 - protein, 34 aa, Artificial Sequence; identical to SEQ ID NO: 1160
  Description of Artificial Sequence: Synthetic peptide
  MOD_RES (12)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1291 - protein, 34 aa, Artificial Sequence; identical to SEQ ID NO: 1161
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1292 - protein, 34 aa, Artificial Sequence; identical to SEQ ID NO: 1162
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1293 - protein, 34 aa, Artificial Sequence; identical to SEQ ID NO: 1163
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1294 - protein, 34 aa, Artificial Sequence; identical to SEQ ID NO: 1164
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1295 - protein, 34 aa, Artificial Sequence; identical to SEQ ID NO: 1165
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1296 - protein, 34 aa, Artificial Sequence; identical to SEQ ID NO: 1166
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1297 - protein, 34 aa, Artificial Sequence; identical to SEQ ID NO: 1167
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1298 - protein, 34 aa, Artificial Sequence; identical to SEQ ID NO: 1168
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1299 - protein, 34 aa, Artificial Sequence; identical to SEQ ID NO: 1169
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1300 - protein, 34 aa, Artificial Sequence; identical to SEQ ID NO: 1170
  Description of Artificial Sequence: Synthetic peptide
  MOD_RES (9)..(12): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1301 - protein, 34 aa, Artificial Sequence; identical to SEQ ID NO: 1171
  Description of Artificial Sequence: Synthetic peptide
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1302 - protein, 34 aa, Artificial Sequence; identical to SEQ ID NO: 1172
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1303 - protein, 34 aa, Artificial Sequence; identical to SEQ ID NO: 1173
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1304 - protein, 34 aa, Artificial Sequence; identical to SEQ ID NO: 1174
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1305 - protein, 34 aa, Artificial Sequence; identical to SEQ ID NO: 1175
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1306 - protein, 34 aa, Artificial Sequence; identical to SEQ ID NO: 1176
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1307 - protein, 34 aa, Artificial Sequence; identical to SEQ ID NO: 1177
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1308 - protein, 34 aa, Artificial Sequence; identical to SEQ ID NO: 1178
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1309 - protein, 34 aa, Artificial Sequence; identical to SEQ ID NO: 1179
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1310 - protein, 34 aa, Artificial Sequence; identical to SEQ ID NO: 1180
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1311 - protein, 34 aa, Artificial Sequence; identical to SEQ ID NO: 1181
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1312 - protein, 34 aa, Artificial Sequence; identical to SEQ ID NO: 1182
  Description of Artificial Sequence: Synthetic peptide
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1313 - protein, 34 aa, Artificial Sequence; identical to SEQ ID NO: 1183
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1314 - protein, 34 aa, Artificial Sequence; identical to SEQ ID NO: 1184
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1315 - protein, 34 aa, Artificial Sequence; identical to SEQ ID NO: 1185
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1316 - protein, 34 aa, Artificial Sequence; identical to SEQ ID NO: 1186
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1317 - protein, 34 aa, Artificial Sequence; identical to SEQ ID NO: 1187
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1318 - protein, 34 aa, Artificial Sequence; identical to SEQ ID NO: 1188
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1319 - protein, 34 aa, Artificial Sequence; identical to SEQ ID NO: 1189
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1320 - protein, 34 aa, Artificial Sequence; identical to SEQ ID NO: 1190
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1321 - protein, 34 aa, Artificial Sequence; identical to SEQ ID NO: 1191
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1322 - protein, 34 aa, Artificial Sequence; identical to SEQ ID NO: 1192
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1323 - protein, 34 aa, Artificial Sequence; identical to SEQ ID NO: 1193
  Description of Artificial Sequence: Synthetic peptide
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1324 - protein, 34 aa, Artificial Sequence; identical to SEQ ID NO: 1194
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1325 - protein, 34 aa, Artificial Sequence; identical to SEQ ID NO: 1195
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1326 - protein, 34 aa, Artificial Sequence; identical to SEQ ID NO: 1196
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1327 - protein, 34 aa, Artificial Sequence; identical to SEQ ID NO: 1197
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1328 - protein, 34 aa, Artificial Sequence; identical to SEQ ID NO: 1198
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1329 - protein, 34 aa, Artificial Sequence; identical to SEQ ID NO: 1199
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1330 - protein, 34 aa, Artificial Sequence; identical to SEQ ID NO: 1200
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1331 - protein, 34 aa, Artificial Sequence; identical to SEQ ID NO: 1201
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1332 - protein, 34 aa, Artificial Sequence; identical to SEQ ID NO: 1202
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1333 - protein, 34 aa, Artificial Sequence; identical to SEQ ID NO: 1203
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (15)..(15): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1334 - protein, 34 aa, Artificial Sequence; identical to SEQ ID NO: 1204
  Description of Artificial Sequence: Synthetic peptide
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1335 - protein, 34 aa, Artificial Sequence; identical to SEQ ID NO: 1205
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1336 - protein, 34 aa, Artificial Sequence; identical to SEQ ID NO: 1206
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1337 - protein, 34 aa, Artificial Sequence; identical to SEQ ID NO: 1207
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1338 - protein, 34 aa, Artificial Sequence; identical to SEQ ID NO: 1208
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1339 - protein, 34 aa, Artificial Sequence; identical to SEQ ID NO: 1209
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (16)..(16): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1340 - protein, 34 aa, Artificial Sequence; identical to SEQ ID NO: 1210
  Description of Artificial Sequence: Synthetic peptide
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1341 - protein, 34 aa, Artificial Sequence; identical to SEQ ID NO: 1211
  Description of Artificial Sequence: Synthetic peptide
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1342 - protein, 34 aa, Artificial Sequence; identical to SEQ ID NO: 1212
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1343 - protein, 34 aa, Artificial Sequence; identical to SEQ ID NO: 1213
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1344 - protein, 34 aa, Artificial Sequence; identical to SEQ ID NO: 1214
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1345 - protein, 34 aa, Artificial Sequence; identical to SEQ ID NO: 1215
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1346 - protein, 34 aa, Artificial Sequence; identical to SEQ ID NO: 1216
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1347 - protein, 34 aa, Artificial Sequence; identical to SEQ ID NO: 1217
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1348 - protein, 34 aa, Artificial Sequence; identical to SEQ ID NO: 1218
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1349 - protein, 34 aa, Artificial Sequence; identical to SEQ ID NO: 1219
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (10)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1350 - protein, 34 aa, Artificial Sequence; identical to SEQ ID NO: 1220
  Description of Artificial Sequence: Synthetic peptide
  MOD_RES (9)..(11): Any L- or D-natural amino acid and any non-natural amino acid; see  specification as filed for detail ed description of substitutions, R-groups  and preferred embodiments
  MOD_RES (17)..(17): Any L- or D-natural amino acid and any non-natural amino acid; see  specification as filed for detail ed description of substitutions, R-groups  and preferred embodiments
  MOD_RES (18)..(21): Any L- or D-natural or non-natural amino acid, and this range may     encompass 1 or 4 residues; see specification as filed for detailed  description of substitutions, R-groups and preferred emb
  c-term may be amidated

SEQ ID NO: 1351 - protein, 35 aa, Artificial Sequence
  Description of Artificial Sequence: Synthetic peptide
  c-term may be amidated
QPDAINAPVTCCYNFTNRKISVQRLASYRRITSSK

SEQ ID NO: 1352 - protein, 35 aa, Artificial Sequence
  Description of Artificial Sequence: Synthetic peptide
  MOD_RES (11)..(12): Any L- or D-natural amino acid and any non-natural amino acid; see  specification as filed for detail ed description of substitutions, R-groups  and preferred embodiments
  c-term may be amidated
QPDAINAPVTXXYNFTNRKISVQRLASYRRITSSK

SEQ ID NO: 1353 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
XPDAINAPVTXXYNFTNRKISVQRLASYRRITSSK

SEQ ID NO: 1354 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QXDAINAPVTXXYNFTNRKISVQRLASYRRITSSK

SEQ ID NO: 1355 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPXAINAPVTXXYNFTNRKISVQRLASYRRITSSK

SEQ ID NO: 1356 - protein, 35 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDXINAPVTXXYNFTNRKISVQRLASYRRITSSK

SEQ ID NO: 1357 - protein, 35 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAXNAPVTXXYNFTNRKISVQRLASYRRITSSK

SEQ ID NO: 1358 - protein, 35 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAIXAPVTXXYNFTNRKISVQRLASYRRITSSK

SEQ ID NO: 1359 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINXPVTXXYNFTNRKISVQRLASYRRITSSK

SEQ ID NO: 1360 - protein, 35 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINAXVTXXYNFTNRKISVQRLASYRRITSSK

SEQ ID NO: 1361 - protein, 35 aa, Artificial Sequence
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINAPXTXXYNFTNRKISVQRLASYRRITSSK

SEQ ID NO: 1362 - protein, 35 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  c-term may be amidated
QPDAINAPVXXXYNFTNRKISVQRLASYRRITSSK

SEQ ID NO: 1363 - protein, 35 aa, Artificial Sequence
  Description of Artificial Sequence: Synthetic peptide
  c-term may be amidated
QPDAINAPVTCCENFTNRKISVQRLASYRRITSSK

SEQ ID NO: 1364 - protein, 35 aa, Artificial Sequence
  Description of Artificial Sequence: Synthetic peptide
  MOD_RES (11)..(12): Any L- or D-natural amino acid and any non-natural amino acid; see  specification as filed for detail ed description of substitutions, R-groups  and preferred embodiments
  c-term may be amidated
QPDAINAPVTXXENFTNRKISVQRLASYRRITSSK

SEQ ID NO: 1365 - protein, 35 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
XPDAINAPVTXXENFTNRKISVQRLASYRRITSSK

SEQ ID NO: 1366 - protein, 35 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QXDAINAPVTXXENFTNRKISVQRLASYRRITSSK

SEQ ID NO: 1367 - protein, 35 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPXAINAPVTXXENFTNRKISVQRLASYRRITSSK

SEQ ID NO: 1368 - protein, 35 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDXINAPVTXXENFTNRKISVQRLASYRRITSSK

SEQ ID NO: 1369 - protein, 35 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAXNAPVTXXENFTNRKISVQRLASYRRITSSK

SEQ ID NO: 1370 - protein, 35 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAIXAPVTXXENFTNRKISVQRLASYRRITSSK

SEQ ID NO: 1371 - protein, 35 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINXPVTXXENFTNRKISVQRLASYRRITSSK

SEQ ID NO: 1372 - protein, 35 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINAXVTXXENFTNRKISVQRLASYRRITSSK

SEQ ID NO: 1373 - protein, 35 aa, Artificial Sequence
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  c-term may be amidated
QPDAINAPXTXXENFTNRKISVQRLASYRRITSSK

SEQ ID NO: 1374 - protein, 35 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  c-term may be amidated
QPDAINAPVXXXENFTNRKISVQRLASYRRITSSK

SEQ ID NO: 1375 - protein, 26 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  c-term may be amidated
AKXNFTNRKISVQRLASYRRITSSKE

SEQ ID NO: 1376 - protein, 15 aa, Artificial Sequence
  Description of Artificial Sequence: Synthetic peptide
  c-term may be amidated
PKEAVIFKTIVAKEI

SEQ ID NO: 1377 - protein, 19 aa, Artificial Sequence
  Description of Artificial Sequence: Synthetic peptide
  c-term may be amidated
ADPKQKWVQDSMDHLDKQT

SEQ ID NO: 1378 - protein, 41 aa, Artificial Sequence
  Description of Artificial Sequence: Synthetic peptide
  MOD_RES (24)..(27): Any L- or D-natural or non-natural amino acid, and this range may     encompass 1 or 4 residues; see specification as filed for detailed  description of substitutions, R-groups and preferred emb
  c-term may be amidated
YNFTNRKISVQRLASYRRITSSKXXXXKWVQDSMDHLDKQT

SEQ ID NO: 1379 - protein, 32 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPVTCCYNXXXXKWVQDSMDHLDKQT

SEQ ID NO: 1380 - protein, 32 aa, Artificial Sequence
  Description of Artificial Sequence: Synthetic peptide
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPVTXXYNXXXXKWVQDSMDHLDKQT

SEQ ID NO: 1381 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPDAINAPVTXXYNXXXXKWVQDSMDHLDKQT

SEQ ID NO: 1382 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QXDAINAPVTXXYNXXXXKWVQDSMDHLDKQT

SEQ ID NO: 1383 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPXAINAPVTXXYNXXXXKWVQDSMDHLDKQT

SEQ ID NO: 1384 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDXINAPVTXXYNXXXXKWVQDSMDHLDKQT

SEQ ID NO: 1385 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAXNAPVTXXYNXXXXKWVQDSMDHLDKQT

SEQ ID NO: 1386 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAIXAPVTXXYNXXXXKWVQDSMDHLDKQT

SEQ ID NO: 1387 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINXPVTXXYNXXXXKWVQDSMDHLDKQT

SEQ ID NO: 1388 - protein, 32 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAXVTXXYNXXXXKWVQDSMDHLDKQT

SEQ ID NO: 1389 - protein, 32 aa, Artificial Sequence
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPXTXXYNXXXXKWVQDSMDHLDKQT

SEQ ID NO: 1390 - protein, 32 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPVXXXYNXXXXKWVQDSMDHLDKQT

SEQ ID NO: 1391 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPDAINAPVTXXXNXXXXKWVQDSMDHLDKQT

SEQ ID NO: 1392 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QXDAINAPVTXXXNXXXXKWVQDSMDHLDKQT

SEQ ID NO: 1393 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPXAINAPVTXXXNXXXXKWVQDSMDHLDKQT

SEQ ID NO: 1394 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDXINAPVTXXXNXXXXKWVQDSMDHLDKQT

SEQ ID NO: 1395 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAXNAPVTXXXNXXXXKWVQDSMDHLDKQT

SEQ ID NO: 1396 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAIXAPVTXXXNXXXXKWVQDSMDHLDKQT

SEQ ID NO: 1397 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINXPVTXXXNXXXXKWVQDSMDHLDKQT

SEQ ID NO: 1398 - protein, 32 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAXVTXXXNXXXXKWVQDSMDHLDKQT

SEQ ID NO: 1399 - protein, 32 aa, Artificial Sequence
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPXTXXXNXXXXKWVQDSMDHLDKQT

SEQ ID NO: 1400 - protein, 32 aa, Artificial Sequence
  Description of Artificial Sequence: Synthetic peptide
  MOD_RES (10)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPVXXXXNXXXXKWVQDSMDHLDKQT

SEQ ID NO: 1401 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XPDAINAPVTXXYXXXXXKWVQDSMDHLDKQT

SEQ ID NO: 1402 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QXDAINAPVTXXYXXXXXKWVQDSMDHLDKQT

SEQ ID NO: 1403 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPXAINAPVTXXYXXXXXKWVQDSMDHLDKQT

SEQ ID NO: 1404 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDXINAPVTXXYXXXXXKWVQDSMDHLDKQT

SEQ ID NO: 1405 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAXNAPVTXXYXXXXXKWVQDSMDHLDKQT

SEQ ID NO: 1406 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAIXAPVTXXYXXXXXKWVQDSMDHLDKQT

SEQ ID NO: 1407 - protein, 32 aa, Artificial Sequence
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINXPVTXXYXXXXXKWVQDSMDHLDKQT

SEQ ID NO: 1408 - protein, 32 aa, Artificial Sequence
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAXVTXXYXXXXXKWVQDSMDHLDKQT

SEQ ID NO: 1409 - protein, 32 aa, Artificial Sequence
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPXTXXYXXXXXKWVQDSMDHLDKQT

SEQ ID NO: 1410 - protein, 32 aa, Artificial Sequence
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
QPDAINAPVXXXYXXXXXKWVQDSMDHLDKQT

SEQ ID NO: 1411 - protein, 26 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  c-term may be amidated
AKXNFTNRKISVQRLASYRRITSSKE

SEQ ID NO: 1412 - protein, 26 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  c-term may be amidated
AKXNFTNRKISVQRLASYRRITSSKE

SEQ ID NO: 1413 - protein, 35 aa, Artificial Sequence; identical to SEQ ID NO: 1364
  Description of Artificial Sequence: Synthetic peptide
  MOD_RES (11)..(12): Any L- or D-natural amino acid and any non-natural amino acid; see  specification as filed for detail ed description of substitutions, R-groups  and preferred embodiments
  c-term may be amidated

SEQ ID NO: 1414 - protein, 32 aa, Artificial Sequence; identical to SEQ ID NO: 1379
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1415 - protein, 32 aa, Artificial Sequence; identical to SEQ ID NO: 1380
  Description of Artificial Sequence: Synthetic peptide
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1416 - protein, 41 aa, Artificial Sequence; identical to SEQ ID NO: 1378
  Description of Artificial Sequence: Synthetic peptide
  MOD_RES (24)..(27): Any L- or D-natural or non-natural amino acid, and this range may     encompass 1 or 4 residues; see specification as filed for detailed  description of substitutions, R-groups and preferred emb
  c-term may be amidated

SEQ ID NO: 1417 - protein, 32 aa, Artificial Sequence; identical to SEQ ID NO: 1381
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1418 - protein, 32 aa, Artificial Sequence; identical to SEQ ID NO: 1382
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1419 - protein, 32 aa, Artificial Sequence; identical to SEQ ID NO: 1383
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1420 - protein, 32 aa, Artificial Sequence; identical to SEQ ID NO: 1384
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1421 - protein, 32 aa, Artificial Sequence; identical to SEQ ID NO: 1385
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1422 - protein, 32 aa, Artificial Sequence; identical to SEQ ID NO: 1386
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1423 - protein, 32 aa, Artificial Sequence; identical to SEQ ID NO: 1387
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1424 - protein, 32 aa, Artificial Sequence; identical to SEQ ID NO: 1388
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1425 - protein, 32 aa, Artificial Sequence; identical to SEQ ID NO: 1389
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1426 - protein, 32 aa, Artificial Sequence; identical to SEQ ID NO: 1390
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1427 - protein, 32 aa, Artificial Sequence; identical to SEQ ID NO: 1391
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1428 - protein, 32 aa, Artificial Sequence; identical to SEQ ID NO: 1392
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1429 - protein, 32 aa, Artificial Sequence; identical to SEQ ID NO: 1393
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1430 - protein, 32 aa, Artificial Sequence; identical to SEQ ID NO: 1394
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1431 - protein, 32 aa, Artificial Sequence; identical to SEQ ID NO: 1395
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1432 - protein, 32 aa, Artificial Sequence; identical to SEQ ID NO: 1396
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1433 - protein, 32 aa, Artificial Sequence; identical to SEQ ID NO: 1397
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1434 - protein, 32 aa, Artificial Sequence; identical to SEQ ID NO: 1398
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1435 - protein, 32 aa, Artificial Sequence; identical to SEQ ID NO: 1399
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1436 - protein, 32 aa, Artificial Sequence; identical to SEQ ID NO: 1400
  Description of Artificial Sequence: Synthetic peptide
  MOD_RES (10)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1437 - protein, 32 aa, Artificial Sequence; identical to SEQ ID NO: 1401
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1438 - protein, 32 aa, Artificial Sequence; identical to SEQ ID NO: 1402
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1439 - protein, 32 aa, Artificial Sequence; identical to SEQ ID NO: 1403
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1440 - protein, 32 aa, Artificial Sequence; identical to SEQ ID NO: 1404
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1441 - protein, 32 aa, Artificial Sequence; identical to SEQ ID NO: 1405
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1442 - protein, 32 aa, Artificial Sequence; identical to SEQ ID NO: 1406
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1443 - protein, 32 aa, Artificial Sequence; identical to SEQ ID NO: 1407
  Description of Artificial Sequence: Synthetic peptide
  MOD_RES (7)..(7): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1444 - protein, 32 aa, Artificial Sequence; identical to SEQ ID NO: 1408
  Description of Artificial Sequence: Synthetic peptide
  MOD_RES (8)..(8): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1445 - protein, 32 aa, Artificial Sequence; identical to SEQ ID NO: 1409
  Description of Artificial Sequence: Synthetic peptide
  MOD_RES (9)..(9): Any L- or D-natural amino acid and any non-natural amino acid; see  specification as filed for detail ed description of substitutions, R-groups  and preferred embodiments
  MOD_RES (11)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1446 - protein, 32 aa, Artificial Sequence; identical to SEQ ID NO: 1410
  Description of Artificial Sequence: Synthetic peptide
  MOD_RES (10)..(12): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1447 - protein, 7 aa, Artificial Sequence
  Description of Artificial Sequence: Synthetic peptide
  c-term may be amidated
ILPIASS

SEQ ID NO: 1448 - protein, 26 aa, Artificial Sequence
  Description of Artificial Sequence: Synthetic peptide
  c-term may be amidated
ILPIASSCCTEVSHHISRRLLERVNM

SEQ ID NO: 1449 - protein, 26 aa, Artificial Sequence
  Description of Artificial Sequence: Synthetic peptide
  MOD_RES (8)..(9): Any L- or D-natural amino acid and any non-natural amino acid; see  specification as filed for detail ed description of substitutions, R-groups  and preferred embodiments
  c-term may be amidated
ILPIASSXXTEVSHHISRRLLERVNM

SEQ ID NO: 1450 - protein, 26 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
XLPIASSXXTEVSHHISRRLLERVNM

SEQ ID NO: 1451 - protein, 26 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
IXPIASSXXTEVSHHISRRLLERVNM

SEQ ID NO: 1452 - protein, 26 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
ILXIASSXXTEVSHHISRRLLERVNM

SEQ ID NO: 1453 - protein, 26 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
ILPXASSXXTEVSHHISRRLLERVNM

SEQ ID NO: 1454 - protein, 26 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
ILPIXSSXXTEVSHHISRRLLERVNM

SEQ ID NO: 1455 - protein, 26 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  c-term may be amidated
ILPIAXSXXTEVSHHISRRLLERVNM

SEQ ID NO: 1456 - protein, 26 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  c-term may be amidated
ILPIASXXXTEVSHHISRRLLERVNM

SEQ ID NO: 1457 - protein, 17 aa, Artificial Sequence
  Description of Artificial Sequence: Synthetic peptide
  c-term may be amidated
TEVSHHISRRLLERVNM

SEQ ID NO: 1458 - protein, 23 aa, Artificial Sequence
  Description of Artificial Sequence: Synthetic peptide
  c-term may be amidated
RIQRADGDCDLAAVILHVKRRRI

SEQ ID NO: 1459 - protein, 25 aa, Artificial Sequence
  Description of Artificial Sequence: Synthetic peptide
  c-term may be amidated
VSPHNHTVKQWMKVQAAKKNGKGNV

SEQ ID NO: 1460 - protein, 28 aa, Artificial Sequence
  Description of Artificial Sequence: Synthetic peptide
  c-term may be amidated
HRKKHHGKRNSNRAHQGKHETYGHKTPY

SEQ ID NO: 1461 - protein, 32 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASSCCTEVSHXXXXHRKKHHGKRNSDRA

SEQ ID NO: 1462 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVSHXXXXHRKKHHGKRNSDRA

SEQ ID NO: 1463 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVSHXXXXHRKKHHGKRNSDRA

SEQ ID NO: 1464 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVSHXXXXHRKKHHGKRNSDRA

SEQ ID NO: 1465 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVSHXXXXHRKKHHGKRNSDRA

SEQ ID NO: 1466 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVSHXXXXHRKKHHGKRNSDRA

SEQ ID NO: 1467 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVSHXXXXHRKKHHGKRNSDRA

SEQ ID NO: 1468 - protein, 32 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVSHXXXXHRKKHHGKRNSDRA

SEQ ID NO: 1469 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXXEVSHXXXXHRKKHHGKRNSDRA

SEQ ID NO: 1470 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXXEVSHXXXXHRKKHHGKRNSDRA

SEQ ID NO: 1471 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXXEVSHXXXXHRKKHHGKRNSDRA

SEQ ID NO: 1472 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXXEVSHXXXXHRKKHHGKRNSDRA

SEQ ID NO: 1473 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXXEVSHXXXXHRKKHHGKRNSDRA

SEQ ID NO: 1474 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXXEVSHXXXXHRKKHHGKRNSDRA

SEQ ID NO: 1475 - protein, 32 aa, Artificial Sequence
  Description of Artificial Sequence: Synthetic peptide
  MOD_RES (7)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXXEVSHXXXXHRKKHHGKRNSDRA

SEQ ID NO: 1476 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTXVSHXXXXHRKKHHGKRNSDRA

SEQ ID NO: 1477 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTXVSHXXXXHRKKHHGKRNSDRA

SEQ ID NO: 1478 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTXVSHXXXXHRKKHHGKRNSDRA

SEQ ID NO: 1479 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTXVSHXXXXHRKKHHGKRNSDRA

SEQ ID NO: 1480 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTXVSHXXXXHRKKHHGKRNSDRA

SEQ ID NO: 1481 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTXVSHXXXXHRKKHHGKRNSDRA

SEQ ID NO: 1482 - protein, 32 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTXVSHXXXXHRKKHHGKRNSDRA

SEQ ID NO: 1483 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEXSHXXXXHRKKHHGKRNSDRA

SEQ ID NO: 1484 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEXSHXXXXHRKKHHGKRNSDRA

SEQ ID NO: 1485 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEXSHXXXXHRKKHHGKRNSDRA

SEQ ID NO: 1486 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEXSHXXXXHRKKHHGKRNSDRA

SEQ ID NO: 1487 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEXSHXXXXHRKKHHGKRNSDRA

SEQ ID NO: 1488 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEXSHXXXXHRKKHHGKRNSDRA

SEQ ID NO: 1489 - protein, 32 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEXSHXXXXHRKKHHGKRNSDRA

SEQ ID NO: 1490 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVXHXXXXHRKKHHGKRNSDRA

SEQ ID NO: 1491 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVXHXXXXHRKKHHGKRNSDRA

SEQ ID NO: 1492 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVXHXXXXHRKKHHGKRNSDRA

SEQ ID NO: 1493 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVXHXXXXHRKKHHGKRNSDRA

SEQ ID NO: 1494 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVXHXXXXHRKKHHGKRNSDRA

SEQ ID NO: 1495 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVXHXXXXHRKKHHGKRNSDRA

SEQ ID NO: 1496 - protein, 32 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVXHXXXXHRKKHHGKRNSDRA

SEQ ID NO: 1497 - protein, 32 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVSXXXXXHRKKHHGKRNSDRA

SEQ ID NO: 1498 - protein, 32 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVSXXXXXHRKKHHGKRNSDRA

SEQ ID NO: 1499 - protein, 32 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVSXXXXXHRKKHHGKRNSDRA

SEQ ID NO: 1500 - protein, 32 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVSXXXXXHRKKHHGKRNSDRA

SEQ ID NO: 1501 - protein, 32 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVSXXXXXHRKKHHGKRNSDRA

SEQ ID NO: 1502 - protein, 32 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVSXXXXXHRKKHHGKRNSDRA

SEQ ID NO: 1503 - protein, 32 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVSXXXXXHRKKHHGKRNSDRA

SEQ ID NO: 1504 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVSHXXXXAHQGKHETYGHKTPY

SEQ ID NO: 1505 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVSHXXXXAHQGKHETYGHKTPY

SEQ ID NO: 1506 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVSHXXXXAHQGKHETYGHKTPY

SEQ ID NO: 1507 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVSHXXXXAHQGKHETYGHKTPY

SEQ ID NO: 1508 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVSHXXXXAHQGKHETYGHKTPY

SEQ ID NO: 1509 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVSHXXXXAHQGKHETYGHKTPY

SEQ ID NO: 1510 - protein, 33 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVSHXXXXAHQGKHETYGHKTPY

SEQ ID NO: 1511 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXXEVSHXXXXAHQGKHETYGHKTPY

SEQ ID NO: 1512 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXXEVSHXXXXAHQGKHETYGHKTPY

SEQ ID NO: 1513 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXXEVSHXXXXAHQGKHETYGHKTPY

SEQ ID NO: 1514 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXXEVSHXXXXAHQGKHETYGHKTPY

SEQ ID NO: 1515 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXXEVSHXXXXAHQGKHETYGHKTPY

SEQ ID NO: 1516 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXXEVSHXXXXAHQGKHETYGHKTPY

SEQ ID NO: 1517 - protein, 33 aa, Artificial Sequence
  Description of Artificial Sequence: Synthetic peptide
  MOD_RES (7)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXXEVSHXXXXAHQGKHETYGHKTPY

SEQ ID NO: 1518 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTXVSHXXXXAHQGKHETYGHKTPY

SEQ ID NO: 1519 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTXVSHXXXXAHQGKHETYGHKTPY

SEQ ID NO: 1520 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTXVSHXXXXAHQGKHETYGHKTPY

SEQ ID NO: 1521 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTXVSHXXXXAHQGKHETYGHKTPY

SEQ ID NO: 1522 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTXVSHXXXXAHQGKHETYGHKTPY

SEQ ID NO: 1523 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTXVSHXXXXAHQGKHETYGHKTPY

SEQ ID NO: 1524 - protein, 33 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTXVSHXXXXAHQGKHETYGHKTPY

SEQ ID NO: 1525 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEXSHXXXXAHQGKHETYGHKTPY

SEQ ID NO: 1526 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEXSHXXXXAHQGKHETYGHKTPY

SEQ ID NO: 1527 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEXSHXXXXAHQGKHETYGHKTPY

SEQ ID NO: 1528 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEXSHXXXXAHQGKHETYGHKTPY

SEQ ID NO: 1529 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEXSHXXXXAHQGKHETYGHKTPY

SEQ ID NO: 1530 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEXSHXXXXAHQGKHETYGHKTPY

SEQ ID NO: 1531 - protein, 33 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEXSHXXXXAHQGKHETYGHKTPY

SEQ ID NO: 1532 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVXHXXXXAHQGKHETYGHKTPY

SEQ ID NO: 1533 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVXHXXXXAHQGKHETYGHKTPY

SEQ ID NO: 1534 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVXHXXXXAHQGKHETYGHKTPY

SEQ ID NO: 1535 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVXHXXXXAHQGKHETYGHKTPY

SEQ ID NO: 1536 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVXHXXXXAHQGKHETYGHKTPY

SEQ ID NO: 1537 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVXHXXXXAHQGKHETYGHKTPY

SEQ ID NO: 1538 - protein, 33 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVXHXXXXAHQGKHETYGHKTPY

SEQ ID NO: 1539 - protein, 33 aa, Artificial Sequence
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
XLPIASSXXTEVSXXXXXAHQGKHETYGHKTPY

SEQ ID NO: 1540 - protein, 33 aa, Artificial Sequence
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
IXPIASSXXTEVSXXXXXAHQGKHETYGHKTPY

SEQ ID NO: 1541 - protein, 33 aa, Artificial Sequence
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILXIASSXXTEVSXXXXXAHQGKHETYGHKTPY

SEQ ID NO: 1542 - protein, 33 aa, Artificial Sequence
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPXASSXXTEVSXXXXXAHQGKHETYGHKTPY

SEQ ID NO: 1543 - protein, 33 aa, Artificial Sequence
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIXSSXXTEVSXXXXXAHQGKHETYGHKTPY

SEQ ID NO: 1544 - protein, 33 aa, Artificial Sequence
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIAXSXXTEVSXXXXXAHQGKHETYGHKTPY

SEQ ID NO: 1545 - protein, 33 aa, Artificial Sequence
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASXXXTEVSXXXXXAHQGKHETYGHKTPY

SEQ ID NO: 1546 - protein, 32 aa, Artificial Sequence; identical to SEQ ID NO: 1461
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1547 - protein, 32 aa, Artificial Sequence; identical to SEQ ID NO: 1462
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1548 - protein, 32 aa, Artificial Sequence; identical to SEQ ID NO: 1463
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1549 - protein, 32 aa, Artificial Sequence; identical to SEQ ID NO: 1464
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1550 - protein, 32 aa, Artificial Sequence; identical to SEQ ID NO: 1465
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1551 - protein, 32 aa, Artificial Sequence; identical to SEQ ID NO: 1466
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1552 - protein, 32 aa, Artificial Sequence; identical to SEQ ID NO: 1467
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1553 - protein, 32 aa, Artificial Sequence; identical to SEQ ID NO: 1468
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1554 - protein, 32 aa, Artificial Sequence; identical to SEQ ID NO: 1469
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1555 - protein, 32 aa, Artificial Sequence; identical to SEQ ID NO: 1470
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1556 - protein, 32 aa, Artificial Sequence; identical to SEQ ID NO: 1471
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1557 - protein, 32 aa, Artificial Sequence; identical to SEQ ID NO: 1472
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1558 - protein, 32 aa, Artificial Sequence; identical to SEQ ID NO: 1473
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1559 - protein, 32 aa, Artificial Sequence; identical to SEQ ID NO: 1474
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1560 - protein, 32 aa, Artificial Sequence; identical to SEQ ID NO: 1475
  Description of Artificial Sequence: Synthetic peptide
  MOD_RES (7)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1561 - protein, 32 aa, Artificial Sequence; identical to SEQ ID NO: 1476
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1562 - protein, 32 aa, Artificial Sequence; identical to SEQ ID NO: 1477
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1563 - protein, 32 aa, Artificial Sequence; identical to SEQ ID NO: 1478
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1564 - protein, 32 aa, Artificial Sequence; identical to SEQ ID NO: 1479
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1565 - protein, 32 aa, Artificial Sequence; identical to SEQ ID NO: 1480
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1566 - protein, 32 aa, Artificial Sequence; identical to SEQ ID NO: 1481
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1567 - protein, 32 aa, Artificial Sequence; identical to SEQ ID NO: 1482
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1568 - protein, 32 aa, Artificial Sequence; identical to SEQ ID NO: 1483
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1569 - protein, 32 aa, Artificial Sequence; identical to SEQ ID NO: 1484
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1570 - protein, 32 aa, Artificial Sequence; identical to SEQ ID NO: 1485
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1571 - protein, 32 aa, Artificial Sequence; identical to SEQ ID NO: 1486
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1572 - protein, 32 aa, Artificial Sequence; identical to SEQ ID NO: 1487
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1573 - protein, 32 aa, Artificial Sequence; identical to SEQ ID NO: 1488
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1574 - protein, 32 aa, Artificial Sequence; identical to SEQ ID NO: 1489
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1575 - protein, 32 aa, Artificial Sequence; identical to SEQ ID NO: 1490
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1576 - protein, 32 aa, Artificial Sequence; identical to SEQ ID NO: 1491
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1577 - protein, 32 aa, Artificial Sequence; identical to SEQ ID NO: 1492
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1578 - protein, 32 aa, Artificial Sequence; identical to SEQ ID NO: 1493
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1579 - protein, 32 aa, Artificial Sequence; identical to SEQ ID NO: 1494
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1580 - protein, 32 aa, Artificial Sequence; identical to SEQ ID NO: 1495
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1581 - protein, 32 aa, Artificial Sequence; identical to SEQ ID NO: 1496
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1582 - protein, 32 aa, Artificial Sequence; identical to SEQ ID NO: 1497
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1583 - protein, 32 aa, Artificial Sequence; identical to SEQ ID NO: 1498
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1584 - protein, 32 aa, Artificial Sequence; identical to SEQ ID NO: 1499
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1585 - protein, 32 aa, Artificial Sequence; identical to SEQ ID NO: 1500
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1586 - protein, 32 aa, Artificial Sequence; identical to SEQ ID NO: 1501
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1587 - protein, 32 aa, Artificial Sequence; identical to SEQ ID NO: 1502
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1588 - protein, 32 aa, Artificial Sequence; identical to SEQ ID NO: 1503
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1589 - protein, 33 aa, Artificial Sequence
  Description of Artificial Sequence: Synthetic peptide
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated
ILPIASSCCTEVSHXXXXAHQGKHETYGHKTPY

SEQ ID NO: 1590 - protein, 33 aa, Artificial Sequence; identical to SEQ ID NO: 1504
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1591 - protein, 33 aa, Artificial Sequence; identical to SEQ ID NO: 1505
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1592 - protein, 33 aa, Artificial Sequence; identical to SEQ ID NO: 1506
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1593 - protein, 33 aa, Artificial Sequence; identical to SEQ ID NO: 1507
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1594 - protein, 33 aa, Artificial Sequence; identical to SEQ ID NO: 1508
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1595 - protein, 33 aa, Artificial Sequence; identical to SEQ ID NO: 1509
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1596 - protein, 33 aa, Artificial Sequence; identical to SEQ ID NO: 1510
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1597 - protein, 33 aa, Artificial Sequence; identical to SEQ ID NO: 1511
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1598 - protein, 33 aa, Artificial Sequence; identical to SEQ ID NO: 1512
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1599 - protein, 33 aa, Artificial Sequence; identical to SEQ ID NO: 1513
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1600 - protein, 33 aa, Artificial Sequence; identical to SEQ ID NO: 1514
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1601 - protein, 33 aa, Artificial Sequence; identical to SEQ ID NO: 1515
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1602 - protein, 33 aa, Artificial Sequence; identical to SEQ ID NO: 1516
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1603 - protein, 33 aa, Artificial Sequence; identical to SEQ ID NO: 1517
  Description of Artificial Sequence: Synthetic peptide
  MOD_RES (7)..(10): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1604 - protein, 33 aa, Artificial Sequence; identical to SEQ ID NO: 1518
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1605 - protein, 33 aa, Artificial Sequence; identical to SEQ ID NO: 1519
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1606 - protein, 33 aa, Artificial Sequence; identical to SEQ ID NO: 1520
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1607 - protein, 33 aa, Artificial Sequence; identical to SEQ ID NO: 1521
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1608 - protein, 33 aa, Artificial Sequence; identical to SEQ ID NO: 1522
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1609 - protein, 33 aa, Artificial Sequence; identical to SEQ ID NO: 1523
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1610 - protein, 33 aa, Artificial Sequence; identical to SEQ ID NO: 1524
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (11)..(11): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1611 - protein, 33 aa, Artificial Sequence; identical to SEQ ID NO: 1525
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1612 - protein, 33 aa, Artificial Sequence; identical to SEQ ID NO: 1526
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1613 - protein, 33 aa, Artificial Sequence; identical to SEQ ID NO: 1527
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1614 - protein, 33 aa, Artificial Sequence; identical to SEQ ID NO: 1528
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1615 - protein, 33 aa, Artificial Sequence; identical to SEQ ID NO: 1529
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1616 - protein, 33 aa, Artificial Sequence; identical to SEQ ID NO: 1530
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1617 - protein, 33 aa, Artificial Sequence; identical to SEQ ID NO: 1531
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (12)..(12): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1618 - protein, 33 aa, Artificial Sequence; identical to SEQ ID NO: 1532
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1619 - protein, 33 aa, Artificial Sequence; identical to SEQ ID NO: 1533
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1620 - protein, 33 aa, Artificial Sequence; identical to SEQ ID NO: 1534
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1621 - protein, 33 aa, Artificial Sequence; identical to SEQ ID NO: 1535
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1622 - protein, 33 aa, Artificial Sequence; identical to SEQ ID NO: 1536
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1623 - protein, 33 aa, Artificial Sequence; identical to SEQ ID NO: 1537
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1624 - protein, 33 aa, Artificial Sequence; identical to SEQ ID NO: 1538
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (13)..(13): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1625 - protein, 33 aa, Artificial Sequence; identical to SEQ ID NO: 1539
  Description of Artificial Sequence: Synthetic peptide
  MOD_RES (1)..(1): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1626 - protein, 33 aa, Artificial Sequence; identical to SEQ ID NO: 1540
  Description of Artificial Sequence: Synthetic peptide
  MOD_RES (2)..(2): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1627 - protein, 33 aa, Artificial Sequence; identical to SEQ ID NO: 1541
  Description of Artificial Sequence: Synthetic peptide
  MOD_RES (3)..(3): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1628 - protein, 33 aa, Artificial Sequence; identical to SEQ ID NO: 1542
  Description of Artificial Sequence: Synthetic peptide
  MOD_RES (4)..(4): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1629 - protein, 33 aa, Artificial Sequence; identical to SEQ ID NO: 1543
  Description of Artificial Sequence: Synthetic peptide
  MOD_RES (5)..(5): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1630 - protein, 33 aa, Artificial Sequence; identical to SEQ ID NO: 1544
  Description of Artificial Sequence: Synthetic peptide
  MOD_RES (6)..(6): Any L- or D-natural amino acid and any non-natural amino acid; see  specification as filed for detail ed description of substitutions, R-groups  and preferred embodiments
  MOD_RES (8)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1631 - protein, 33 aa, Artificial Sequence; identical to SEQ ID NO: 1545
  Description of Artificial Sequence: Synthetic peptide
  MOD_RES (7)..(9): Any L- or D-natural amino acid and any non-natural amino acid; see  specification as filed for detail ed description of substitutions, R-groups  and preferred embodiments
  MOD_RES (14)..(14): Any L- or D-natural amino acid and any non-natural amino acid; see  specification as filed for detail ed description of substitutions, R-groups  and preferred embodiments
  MOD_RES (15)..(18): Any L- or D-natural or non-natural amino acid, and this range may     encompass 1 or 4 residues; see specification as filed for detailed  description of substitutions, R-groups and preferred emb
  c-term may be amidated

SEQ ID NO: 1632 - protein, 35 aa, Artificial Sequence
  Description of Artificial Sequence: Synthetic peptide
  c-term may be amidated
SAKELRCQCIKTYSKGGGGNWVQRVVEKFLKRAEN

SEQ ID NO: 1633 - protein, 33 aa, Artificial Sequence
  Description of Artificial Sequence: Synthetic peptide
  c-term may be amidated
SAKELRCQCIKTYGGGGNWVQRVVEKFLKRAEN

SEQ ID NO: 1634 - protein, 31 aa, Artificial Sequence
  Description of Artificial Sequence: Synthetic peptide
  c-term may be amidated
SAKELRCQCIKGGGGNWVQRVVEKFLKRAEN

SEQ ID NO: 1635 - protein, 10 aa, Artificial Sequence
  Description of Artificial Sequence: Synthetic peptide
  c-term may be amidated
KSMQVPFSRA

SEQ ID NO: 1636 - protein, 15 aa, Artificial Sequence
  Description of Artificial Sequence: Synthetic peptide
  c-term may be amidated
AFSFAEQEIPLRAIL

SEQ ID NO: 1637 - protein, 23 aa, Artificial Sequence
  Description of Artificial Sequence: Synthetic peptide
  c-term may be amidated
AFSFAEQEIPLRAILCYRNTSSI

SEQ ID NO: 1638 - protein, 24 aa, Artificial Sequence
  Description of Artificial Sequence: Synthetic peptide
  c-term may be amidated
AYRNTSSICSNEGLIFKLKRGKEA

SEQ ID NO: 1639 - protein, 24 aa, Artificial Sequence
  Description of Artificial Sequence: Synthetic peptide
  c-term may be amidated
AALDTVGWVQRHRKMLRHCPSKRK

SEQ ID NO: 1640 - protein, 4 aa, Artificial Sequence
  Description of Artificial Sequence: Synthetic peptide
GGGG

---

We claim:

1. A compound comprising a chemokine analog having a structure consisting of sequence a49:

RNH-Ser-Ala-Lys-Glu-Leu-Arg-Cys-Gln-Cys-Ile-Lys-Thr-Tyr-[linker]-Asn-Trp-Val-Gln-Arg-Val-Val-Glu-Lys-Phe-Leu-Lys-Arg-Ala-Glu-Asn-(OH)NH$_2$ (SEQ ID NO:56); wherein, R comprises a component selected from a group consisting of hydrogen; poly(ethylene glycol); and a biochemical label; and the linker is (1) H$_2$N-Z$_A$-COOH, wherein Z$_A$ is selected from the group consisting of saturated and unsaturated aliphatics consisting of 20 or fewer carbon atoms that are optionally substituted with a hydroxyl, carboxyl, carbonyl, thiol, amino, amido, imino, or aromatic group having from 5 to 7 members in the ring; and —(CH$_2$)$_n$— wherein n is an integer ranging from 9 to 14; or (2) any combination of four natural amino acids.

2. The compound of claim 1, wherein R comprises a poly(ethylene glycol) having a molecular weight of less than about 20,000 Daltons.

3. A method of producing a composition comprising creating a chemokine analog having a structure consisting of sequence a49:

RNH-Ser-Ala-Lys-Glu-Leu-Arg-Cys-Gln-Cys-Ile-Lys-Thr-Tyr-[linker]-Asn-Trp-Val-Gln-Arg-Val-Val-Glu-Lys-Phe-Leu-Lys-Arg-Ala-Glu-Asn-(OH)NH$_2$ (SEQ ID NO:56); wherein, R comprises a component selected from a group consisting of hydrogen; poly(ethylene glycol); and a biochemical label; and the linker is (1) H$_2$N-Z$_A$-COOH, wherein Z$_A$ is selected from the group consisting of saturated and unsaturated aliphatics consisting of 20 or fewer carbon atoms that are optionally substituted with a hydroxyl, carboxyl, carbonyl, thiol, amino, amido, imino, or aromatic group having from 5 to 7 members in the ring; and —(CH$_2$)$_n$— wherein n is an integer ranging from 9 to 14; or (2) any combination of four natural amino acids.

4. A method for increasing the activity of a chemokine receptor comprising contacting said chemokine receptor with a compound comprising a chemokine analog having a structure consisting of sequence a49:

RNH-Ser-Ala-Lys-Glu-Leu-Arg-Cys-Gln-Cys-Ile-Lys-Thr-Tyr-[linker]-Asn-Trp-Val-Gln-Arg-Val-Val-Glu-Lys-Phe-Leu-Lys-Arg-Ala-Glu-Asn-(OH)NH$_2$ (SEQ ID NO:56); wherein, R comprises a component selected from a group consisting of hydrogen; poly(ethylene glycol); and a biochemical label; and the linker is (1) H$_2$N-Z$_A$-COOH, wherein Z$_A$ is selected from the group consisting of saturated and unsaturated aliphatics consisting of 20 or fewer carbon atoms that are optionally substituted with a hydroxyl, carboxyl, carbonyl, thiol, amino, amido, imino, or aromatic group having from 5 to 7 members in the ring; and —(CH$_2$)$_n$— wherein n is an integer ranging from 9 to 14; or (2) any combination of four natural amino acids.

5. The method of claim 4 wherein said chemokine analog comprises a structure consisting of H$_2$N-Ser-Ala-Lys-Glu-Leu-Arg-Cys-Gln-Cys-Ile-Lys-Thr-Tyr-[Gly-Gly-Gly-Gly]-Asn-Trp-Val-Gln-Arg-Val-Val-Glu-Lys-Phe-Leu-Lys-Arg-Ala-Glu-Asn-(OH)NH$_2$ (SEQ ID NO:1633).

6. A method for mobilizing intracellular calcium comprising contacting a chemokine receptor with a compound comprising a chemokine analog having a structure consisting of sequence a49:

RNH-Ser-Ala-Lys-Glu-Leu-Arg-Cys-Gln-Cys-Ile-Lys-Thr-Tyr-[linker]-Asn-Trp-Val-Gln-Arg-Val-Val-Glu-Lys-Phe-Leu-Lys-Arg-Ala-Glu-Asn-(OH)NH$_2$ (SEQ ID NO:56); wherein, R comprises a component selected from a group consisting of hydrogen; poly(ethylene glycol); and a biochemical label; and the linker is (1) H$_2$N-Z$_A$-COOH, wherein Z$_A$ is selected from the group consisting of saturated and unsaturated aliphatics consisting of 20 or fewer carbon atoms that are optionally substituted with a hydroxyl, carboxyl, carbonyl, thiol, amino, amido, imino, or aromatic group having from 5 to 7 members in the ring; and —(CH$_2$)$_n$— wherein n is an integer ranging from 9 to 14; or (2) any combination of four natural amino acids.

7. The compound of claim 1, wherein R comprises a component selected from a group consisting of an acetyl group, a biotinyl group, light scattering group, magnetic group, a radiolabel, or a fluorescein group.

8. The compound of claim 1, wherein the linker comprises an aminoalkanoic acid having 10 or less carbon atoms.

9. The compound of claim 1, wherein the linker is 11-aminoundecanoic acid.

10. A compound comprising a chemokine analog having a structure consisting of

H$_2$N-Ser-Ala-Lys-Glu-Leu-Arg-Cys-Gln-Cys-Ile-Lys-Thr-Tyr-[Gly-Gly-Gly-Gly]-Asn-Trp-Val-Gln-Arg-Val-Val-Glu-Lys-Phe-Leu-Lys-Arg-Ala-Glu-Asn-(OH)NH$_2$ (SEQ ID NO:1633).

11. A composition comprising the compound of claim 1.

12. The method of claim 3, wherein the linker comprises an aminoalkanoic acid having 10 or less carbon atoms.

13. The method of claim 3, wherein the linker is 11-aminoundecanoic acid.

14. The method of claim 4, wherein the linker comprises an aminoalkanoic acid having 10 or less carbon atoms.

15. The method of claim 4, wherein the linker is 11-aminoundecanoic acid.

16. The method of claim 6, wherein the linker comprises an aminoalkanoic acid having 10 or less carbon atoms.

17. The method of claim 6, wherein the linker is 11-aminoundecanoic acid.

* * * * *